(12) United States Patent
Negrete et al.

(10) Patent No.: US 11,661,599 B1
(45) Date of Patent: May 30, 2023

(54) CRISPR-CAS BASED SYSTEM FOR TARGETING SINGLE-STRANDED SEQUENCES

(71) Applicants: National Technology & Engineering Solutions of Sandia, LLC, Albuquerque, NM (US); The Regents of the University of California, Oakland, CA (US)

(72) Inventors: Oscar Negrete, Livermore, CA (US); Jennifer A. Doudna, Berkeley, CA (US); Steven C. Strutt, Berkeley, CA (US)

(73) Assignees: National Technology & Engineering Solutions of Sandia, LLC, Albuquerque, NM (US); The Regents of the University of California, Oakland, CA (US)

( * ) Notice: Subject to any disclaimer, the term of this patent is extended or adjusted under 35 U.S.C. 154(b) by 824 days.

(21) Appl. No.: 16/219,779

(22) Filed: Dec. 13, 2018

Related U.S. Application Data

(60) Provisional application No. 62/598,888, filed on Dec. 14, 2017.

(51) Int. Cl.
| | | |
|---|---|---|
| *C12N 15/11* | (2006.01) | |
| *C12N 9/22* | (2006.01) | |
| *C12Q 1/6888* | (2018.01) | |
| *A61K 31/7088* | (2006.01) | |
| *A61K 38/46* | (2006.01) | |

(52) U.S. Cl.
CPC .......... *C12N 15/11* (2013.01); *A61K 31/7088* (2013.01); *A61K 38/465* (2013.01); *C12N 9/22* (2013.01); *C12Q 1/6888* (2013.01); *C12N 2310/20* (2017.05); *C12N 2800/80* (2013.01)

(58) Field of Classification Search
CPC ...... C12N 15/11; C12N 2310/20; C12N 9/22; C12N 2800/80; C12Q 1/6888
See application file for complete search history.

(56) References Cited

U.S. PATENT DOCUMENTS

| | | | |
|---|---|---|---|
| 7,494,786 B2 | 2/2009 | Doudna et al. | |
| 8,206,968 B2 | 6/2012 | Doudna et al. | |
| 8,440,430 B2 | 5/2013 | Doudna et al. | |
| 8,470,575 B2 | 6/2013 | Doudna et al. | |
| 8,828,736 B2 | 9/2014 | Perroud et al. | |
| 8,852,911 B2 | 10/2014 | Doudna et al. | |
| 8,969,062 B2 | 3/2015 | Doudna et al. | |
| 9,115,348 B2 | 8/2015 | Haurwitz et al. | |
| 9,260,752 B1 | 2/2016 | May et al. | |
| 9,410,198 B2 | 8/2016 | May et al. | |
| 9,434,930 B2 | 9/2016 | Doudna et al. | |
| 9,549,976 B1 | 1/2017 | Peabody et al. | |
| 9,605,246 B2 | 3/2017 | Haurwitz et al. | |
| 9,688,971 B2 | 6/2017 | Doudna et al. | |
| 9,708,646 B2 | 7/2017 | Haurwitz et al. | |
| 9,725,714 B2 | 8/2017 | May et al. | |
| 9,745,610 B2 | 8/2017 | Doudna et al. | |
| 9,803,194 B2 | 10/2017 | May et al. | |
| 9,809,814 B1 | 11/2017 | May et al. | |
| 9,909,122 B2 | 3/2018 | May et al. | |
| 9,963,689 B2 | 5/2018 | Doudna et al. | |
| 9,994,831 B2 * | 6/2018 | Doudna | C12Q 1/6874 |
| 10,000,772 B2 | 6/2018 | Doudna et al. | |
| 10,087,431 B2 | 10/2018 | Wiedenheft et al. | |
| 10,113,167 B2 | 10/2018 | Doudna et al. | |
| 10,125,361 B2 | 11/2018 | May et al. | |
| 2004/0072179 A1 | 4/2004 | Doudna et al. | |
| 2008/0318273 A1 | 12/2008 | Doudna et al. | |
| 2011/0117610 A1 | 5/2011 | Doudna et al. | |
| 2011/0223638 A1 | 9/2011 | Wiedenheft et al. | |
| 2012/0252096 A1 | 10/2012 | Doudna et al. | |
| 2013/0130248 A1 | 5/2013 | Haurwitz et al. | |
| 2013/0196383 A1 | 8/2013 | Doudna et al. | |
| 2013/0337503 A1 | 12/2013 | Doudna et al. | |
| 2014/0068797 A1 | 3/2014 | Doudna et al. | |
| 2014/0302563 A1 | 10/2014 | Doudna et al. | |
| 2014/0315985 A1 | 10/2014 | May et al. | |
| 2015/0152398 A1 | 6/2015 | Doudna et al. | |
| 2015/0152403 A1 | 6/2015 | Doudna et al. | |
| 2015/0272885 A1 | 10/2015 | Ashley et al. | |
| 2015/0284697 A1 | 10/2015 | Haurwitz et al. | |
| 2015/0361406 A1 | 12/2015 | Doudna et al. | |
| 2016/0024568 A1 | 1/2016 | May et al. | |
| 2016/0046949 A1 | 2/2016 | May et al. | |
| 2016/0046961 A1 | 2/2016 | Jinek et al. | |
| 2016/0046962 A1 | 2/2016 | May et al. | |
| 2016/0046963 A1 | 2/2016 | May et al. | |
| 2016/0046978 A1 | 2/2016 | May et al. | |
| 2016/0060653 A1 | 3/2016 | Doudna et al. | |
| 2016/0060654 A1 | 3/2016 | Doudna et al. | |
| 2016/0068864 A1 | 3/2016 | Doudna et al. | |
| 2016/0068887 A1 | 3/2016 | May et al. | |
| 2016/0076020 A1 | 3/2016 | May et al. | |
| 2016/0108470 A1 | 4/2016 | May et al. | |

(Continued)

FOREIGN PATENT DOCUMENTS

WO    WO 2018-107129 A1    6/2018

OTHER PUBLICATIONS

Leenay et al., 2016. Identifying and Visualizing Functional PAM Diversity across CRISPR-Cas Systems. Molecular Cell 62, 137-147 (Year: 2016).*

(Continued)

*Primary Examiner* — Samuel C Woolwine
*Assistant Examiner* — Catherine Konopka
(74) *Attorney, Agent, or Firm* — Helen S. Baca; Madelynne J. Farber; Samantha Updegraff

(57) ABSTRACT

The present invention relates to a CRISPR-Cas based system for targeting nucleic acid sequences. In part, the invention relates to synthetic guiding components for targeting single-stranded sequences, as well as design principles for constructing such components. Also described herein are methods of employing such components, e.g., to repress or activate a desired target within the subject.

33 Claims, 51 Drawing Sheets

Specification includes a Sequence Listing.

(56) References Cited

U.S. PATENT DOCUMENTS

| | | |
|---|---|---|
| 2016/0130608 A1 | 5/2016 | Doudna et al. |
| 2016/0130609 A1 | 5/2016 | Doudna et al. |
| 2016/0138008 A1 | 5/2016 | Doudna et al. |
| 2016/0251640 A1 | 9/2016 | May et al. |
| 2016/0289659 A1* | 10/2016 | Doudna ............... C12N 15/113 |
| 2016/0312280 A1 | 10/2016 | May et al. |
| 2016/0319262 A1 | 11/2016 | Doudna et al. |
| 2016/0319349 A1 | 11/2016 | May et al. |
| 2017/0051276 A1 | 2/2017 | May et al. |
| 2017/0051310 A1 | 2/2017 | Doudna et al. |
| 2017/0051312 A1 | 2/2017 | Jinek et al. |
| 2017/0137801 A1 | 5/2017 | Liras et al. |
| 2017/0166893 A1 | 6/2017 | Doudna et al. |
| 2017/0166958 A1 | 6/2017 | Haurwitz et al. |
| 2017/0175104 A1 | 6/2017 | Doudna et al. |
| 2017/0232115 A1 | 8/2017 | Ashley et al. |
| 2017/0327820 A1 | 11/2017 | May et al. |
| 2017/0360048 A1 | 12/2017 | Nunez et al. |
| 2017/0362644 A1 | 12/2017 | Doudna et al. |
| 2018/0002682 A1 | 1/2018 | Sternberg et al. |
| 2018/0002736 A1 | 1/2018 | O'Connell et al. |
| 2018/0044700 A1 | 2/2018 | Doudna et al. |
| 2018/0142222 A1 | 5/2018 | Sternberg et al. |
| 2018/0208931 A1 | 7/2018 | Doudna et al. |
| 2018/0208976 A1 | 7/2018 | Doudna et al. |
| 2018/0208977 A1 | 7/2018 | Doudna et al. |
| 2018/0230495 A1 | 8/2018 | Doudna et al. |
| 2018/0230496 A1 | 8/2018 | Doudna et al. |
| 2018/0230497 A1 | 8/2018 | Doudna et al. |
| 2018/0237770 A1 | 8/2018 | May et al. |
| 2018/0237801 A1 | 8/2018 | Doudna et al. |
| 2018/0245100 A1 | 8/2018 | Doudna et al. |
| 2018/0245101 A1 | 8/2018 | Doudna et al. |
| 2018/0251791 A1 | 9/2018 | Doudna et al. |
| 2018/0251793 A1 | 9/2018 | Doudna et al. |
| 2018/0251794 A1 | 9/2018 | Doudna et al. |
| 2018/0251795 A1 | 9/2018 | Charpentier et al. |
| 2018/0273922 A1 | 9/2018 | Doudna et al. |
| 2018/0273981 A1 | 9/2018 | Doudna et al. |
| 2018/0274017 A1 | 9/2018 | Abudayyeh et al. |
| 2018/0282764 A1 | 10/2018 | Jinek et al. |
| 2018/0298360 A1 | 10/2018 | Sternberg et al. |
| 2018/0298406 A1 | 10/2018 | Doudna et al. |
| 2018/0298407 A1 | 10/2018 | Doudna et al. |
| 2018/0298445 A1 | 10/2018 | Abudayyeh et al. |
| 2018/0305773 A1 | 10/2018 | Abudayyeh et al. |
| 2018/0312874 A1 | 11/2018 | Doudna et al. |
| 2018/0312875 A1 | 11/2018 | Doudna et al. |
| 2018/0312876 A1 | 11/2018 | Doudna et al. |
| 2018/0340218 A1 | 11/2018 | Abudayyeh et al. |
| 2018/0340219 A1 | 11/2018 | Abudayyeh et al. |
| 2018/0346927 A1 | 12/2018 | Doudna et al. |

OTHER PUBLICATIONS

Kleinstiver et al., 2015. Engineered CRISPR-Cas9 nucleases with altered PAM specificities. Nature 523, 481-485 (Year: 2015).*
Mohanraju et al., Diverse evolutionary roots and mechanistic variations of the CRISPR-Cas systems. Science (2016); 353(6299): aad5147 1-12 (Year: 2016).*
Ma et al., Single-Stranded DNA Cleavage by Divergent CRISPR-Cas9 Enzymes. Mol. Cell Nov. 5, 2015;60(3):398-407. And Supplemental Figures. (Year: 2015).*
BLAST (NCBI BLAST alignment, https://blast.ncbi.nlm.nih.gov/Blast.cgi, retrieved from internet [retrieved Jan. 7, 2021]) (Year: 2021).*
The Baltimore classification clusters viruses into families depending on their type of genome. Swiss Institute of Bioinformatics, https://viralzone.expasy.org/254. Available Jun. 11, 2017. Retrieved from the internet [retrieved Jan. 7, 2022] (Year: 2017).*
Chylinski et al.,Classification and evolution of type II CRISPR-Cas systems Nucl Acids Res, 2014, 42(10): 6091-6105 (Year: 2014).*
Ran et al., In vivo genome editing using *Staphylococcus aureus* Cas9. Nature (2015), 250: 186-191 (Year: 2015).*
BLAST alignment of SEQ ID Nos. 100 (SauCas9) and 111 (CjeCas9) https://blast.ncbi.nlm.nih.gov/Blast.cgi?PROGRAM=blastp&PAGE_TYPE=BlastSearch&LINK_LOC=blasthome, retrieved from internet Jul. 31, 2022 (Year: 2022).*
U.S. Appl. No. 15/204,804, filed Jul. 7, 2016, Negrete et al.
U.S. Appl. No. 15/994,711, filed May 31, 2018, Bird et al.
U.S. Appl. No. 16/141,725, filed Sep. 25, 2018, Sasaki et al.
Abudayyeh OO et al., "C2c2 is a single-component programmable RNA-guided RNA-targeting CRISPR effector," *Science* 2016;353(6299):aaf5573 (23 pp.).
Anders C et al., "Structural basis of PAM-dependent target DNA recognition by the Cas9 endonuclease," *Nature* 2014;513(7519):569-73.
Anders S et al., "HTSeq—a Python framework to work with high-throughput sequencing data," *Bioinformatics* 2015;31(2):166-9.
Batra R et al., "Elimination of toxic microsatellite repeat expansion RNA by RNA-targeting Cas9," *Cell* 2017; 170(5):899-912.
Bercy M et al., "Hairpins under tension: RNA versus DNA," *Nucleic Acids Res.* 2015;43(20):9928-36.
Bisaria N et al., "Lessons from enzyme kinetics reveal specificity principles for RNA-guided nucleases in RNA interference and CRISPR-based genome editing," *Cell Syst.* 2017;4(1):21-9.
Chylinski K et al., "Classification and evolution of type II CRISPR-Cas systems," *Nucleic Acids Res.* 2014;42(10):6091-105.
Chylinski K et al., "The tracrRNA and Cas9 families of type II CRISPR-Cas immunity systems," *RNA Biol.* 2013;10(5):726-37.
Cong L et al., "Multiplex genome engineering using CRISPR/Cas systems," *Science* 2013;339(6121):819-23.
Crooks GE et al., "WebLogo: a sequence logo generator," *Genome Res.* 2004;14(6):1188-90.
Dai X et al., "In situ structures of the genome and genome-delivery apparatus in a single-stranded RNA virus," *Nature* 2017;541(7635):112-6.
Deveau H et al., "Phage response to CRISPR-encoded resistance in *Streptococcus thermophilus*" *J. Bacteriol.* 2008;190:1390-400.
East-Seletsky A et al., "Two distinct RNase activities of CRISPR-C2c2 enable guide-RNA processing and RNA detection," *Nature* 2016;538:270-3.
Freier SM et al., "The ups and downs of nucleic acid duplex stability: structure-stability studies on chemically-modified DNA:RNA duplexes," *Nucleic Acids Res.* 1997;25(22):4429-43.
Friedland AE et al., "Characterization of *Staphylococcus aureus* Cas9: a smaller Cas9 for all-in-one adeno-associated virus delivery and paired nickase applications," *Genome Biol.* 2015;16:257 (10 pp.).
Fu BXH et al., "Distinct patterns of Cas9 mismatch tolerance in vitro and in vivo" *Nucleic Acids Res.* 2016;44(11):5365-77.
Fu Y et al., "Improving CRISPR-Cas nuclease specificity using truncated guide RNAs," *Nat. Biotechnol.* 2014;32(3):279-84.
Garneau JE et al., "The CRISPR/Cas bacterial immune system cleaves bacteriophage and plasmid DNA," *Nature* 2010;468(7320):67-71.
Gasiunas G et al., "Cas9-crRNA ribonucleoprotein complex mediates specific DNA cleavage for adaptive immunity in bacteria," *Proc. Nat'l Acad. Sci. USA* 2012;109(39):E2579-86.
Gilbert LA et al., "Genome-scale CRISPR-mediated control of gene repression and activation," *Cell* 2014;159(3):647-61.
Gorski SA et al., "RNA-based recognition and targeting: sowing the seeds of specificity," *Nat. Rev. Mol. Cell Biol.* 2017;18(4):215-28.
Guindon S et al., "New algorithms and methods to estimate maximum-likelihood phylogenies assessing the performance of PhyML 3.0," *Syst. Biol.* 2010;59(3):307-21.
Hirano H et al., "Structure and engineering of *Francisella novicida* Cas9," *Cell* 2016;164(5):950-61.
Hsu PD et al., "DNA targeting specificity of RNA-guided Cas9 nucleases," *Nat. Biotechnol.* 2013;31(9):827-32.
Jiang F et al., "A Cas9-guide RNA complex preorganized for target DNA recognition," *Science* 2015;348:1477-81.
Jiang F et al., "CRISPR-Cas9 structures and mechanisms," *Annu. Rev. Biophys.* 2017;46:505-29.

(56) References Cited

OTHER PUBLICATIONS

Jiang W et al., "RNA-guided editing of bacterial genomes using CRISPR-Cas systems," *Nat. Biotechnol.* 2013;31(3):233-9.
Jinek M et al., "A programmable dual-RNA-guided DNA endonuclease in adaptive bacterial immunity," *Science* 2012;337(6096):816-21.
Kerpedjiev P et al., "Foma (force-directed RNA): simple and effective online RNA secondary structure diagrams," *Bioinformatics* 2015;31(20):3377-9.
Kim E et al., "In vivo genome editing with a small Cas9 orthologue derived from *Campylobacter jejuni,*" *Nat. Commun.* 2017;8:14500 (12 pp.).
Kleinstiver BP et al., "Broadening the targeting range of *Staphylococcus aureus* CRISPR-Cas9 by modifying PAM recognition," *Nat. Biotechnol.* 2015;33(12):1293-8.
Kou R et al., "Benefits and challenges with applying unique molecular identifiers in next generation sequencing to detect low frequency mutations," *PLoS One* 2016;11(1):e0146638 (15 pp.).
Langmead B et al., "Fast gapped-read alignment with Bowtie 2," *Nat. Methods* 2012;9(4):357-9.
Liu Y et al., "Targeting cellular mRNAs translation by CRISPR-Cas9," *Sci. Rep.* 2016;6:29652 (9 pp.).
Loughrey D et al., "SHAPE—Seq 2.0: systematic optimization and extension of high-throughput chemical probing of RNA secondary structure with next generation sequencing," *Nucleic Acids Res.* 2014;42(21):e165 (10 pp.).
Ma E et al., "Single-stranded DNA cleavage by divergent CRISPR-Cas9 enzymes," *Mol. Cell* Nov. 5, 2015;60(3):398-407.
Makarova KS et al., "Evolution and classification of the CRISPR-Cas systems," *Nat. Rev. Microbiol.* 2011;9:467-77.
Martin M, "Cutadapt removes adapter sequences from high-throughput sequencing reads," *EMBnet.journal* 2011;17(1):10-2.
Masella AP et al., "PANDAseq: PAired-eND Assembler for Illumina sequences," *BMC Bioinformatics* 2012;13:31 (7 pp.).
McCarthy DJ et al., "Differential expression analysis of multifactor RNA-Seq experiments with respect to biological variation," *Nucleic Acids Res.* 2012;40(10):4288-97.
Mohanraju P et al., "Diverse evolutionary roots and mechanistic variations of the CRISPR-Cas systems," *Science* 2016;353(6299):aad5147 (14 pp.).
Mout R et al., "Direct cytosolic delivery of CRISPR/Cas9-ribonucleoprotein for efficient gene editing," *ACS Nano* 2017;11(3):2452-8.
Murovec J et al., "New variants of CRISPR RNA-guided genome editing enzymes," *Plant Biotechnol. J.* 2017;15:917-26.
Myhrvold C et al., "Field-deployable viral diagnostics using CRISPR-Cas13," *Science* 2018;360:444-8.
Nelles DA et al., "Applications of Cas9 as an RNA-programmed RNA-binding protein," *Bioessays* 2015;37(7):732-9.
Nelles DA et al., "Programmable RNA tracking in live cells with CRISPR/Cas9," *Cell* 2016;165(2):488-96.
Nishimasu H et al., "Crystal structure of Cas9 in complex with guide RNA and target DNA," *Cell 2014*;156(5):935-49.
Nishimasu H et al., "Crystal structure of *Staphylococcus aureus* Cas9," *Cell* 2015;162(5):1113-26.
O'Connell MR et al., "Programmable RNA recognition and cleavage by CRISPR/Cas9," *Nature* 2014;516(7530):263-6.
Oakes BL et al., "Profiling of engineering hotspots identifies an allosteric CRISPR-Cas9 switch," *Nat. Biotechnol.* 2016;34(6):646-51.
Pei J et al., "PROMALS3D: a tool for multiple protein sequence and structure alignments," *Nucleic Acids Res.* 2008;36(7):2295-300.
Phanstiel DH et al., "Sushi.R: flexible, quantitative and integrative genomic visualizations for publication-quality multi-panel figures," *Bioinformatics* 2014;30(19):2808-10.
Qi LS et al., "Repurposing CRISPR as an RNA-guided platform for sequence-specific control of gene expression," *Cell* 2013;152(5):1173-83.
Ran FA et al., "In vivo genome editing using *Staphylococcus aureus* Cas9," *Nature* 2015;520(7546):186-91.
Rehmsmeier M et al., "Fast and effective prediction of microRNA/target duplexes," *RNA* 2004;10(10):1507-17.
Rio DC, "Filter-binding assay for analysis of RNA-protein interactions," *Cold Spring Harb. Protoc.* 2012;2012(10):1078-81.
Robinson MD et al., "edgeR: a bioconductor package for differential expression analysis of digital gene expression data," *Bioinformatics* 2010;26(1):139-40.
Sampson TR et al., "A CRISPR/Cas system mediates bacterial innate immune evasion and virulence," *Nature* 2013;497(7448):254-7.
Shmakov S et al., "Discovery and functional characterization of diverse class 2 CRISPR-Cas systems," *Mol. Cell.* 2015;60:385-97.
Smargon AA et al., "Cas13b is a type VI-B CRISPR-associated RNA-guided RNase differentially regulated by accessory proteins Csx27 and Csx28," *Mol. Cell*2017;65(4):618-30.
Smith T et al., "UMI-tools: modeling sequencing errors in Unique Molecular Identifiers to improve quantification accuracy," *Genome Res.* 2017;27(3):491-499.
Sternberg SH et al., "DNA interrogation by the CRISPR RNA-guided endonuclease Cas9," *Nature* 2014;507(7490):62-7.
Sternberg SH et al., "Mechanism of substrate selection by a highly specific CRISPR endoribonuclease," *RNA* 2012;18(4):661-72.
Strutt SC et al., "RNA-dependent RNA targeting by CRISPR-Cas9," *eLife* 2018;7:e32724 (17 pp.).
Szczelkun MD et al., "Direct observation of R-loop formation by single RNA-guided Cas9 and Cascade effector complexes," *Proc. Nat'l Acad. Sci. USA* 2014;111(27):9798-803.
Wang AH et al., "Molecular structure of r(GCG)d(TATACGC): a DNA-RNA hybrid helix joined to double helical DNA," *Nature* 1982;299(5884):601-4.
Wright AV et al., "Biology and applications of CRISPR systems: harnessing nature's toolbox for genome engineering," *Cell* 2016;164(1-2):29-44.
Yamada M et al., "Crystal structure of the minimal Cas9 from *Campylobacter jejuni* reveals the molecular diversity in the CRISPR-Cas9 systems," *Mol. Cell.* 2017;65(6):1109-21.
Zhang Y et al., "DNase H activity of *Neisseria meningitidis* Cas9," *Mol. Cell.* 2015;60(2):242-55.
Zuker M, "Mfold web server for nucleic acid folding and hybridization prediction," *Nucleic Acids Res.* 2003;31(13):3406-15.
Zuris JA et al., "Cationic lipid-mediated delivery of proteins enables efficient protein-based genome editing in vitro and in vivo," *Nat. Biotechnol.* 2015;33(1):73-80.

* cited by examiner

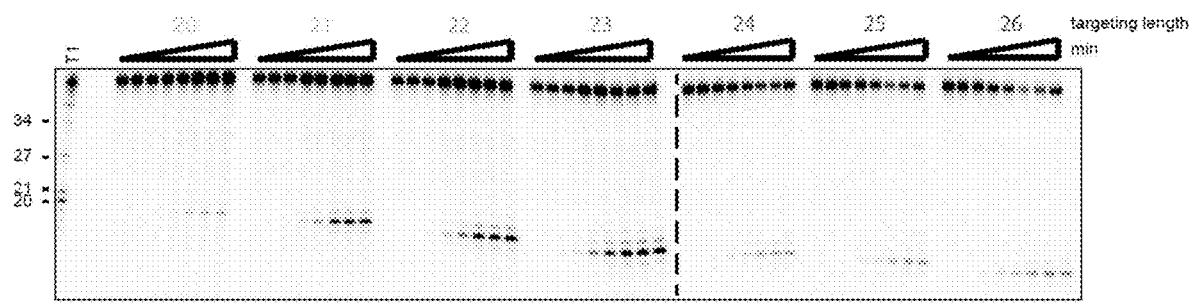
FIG. 7A
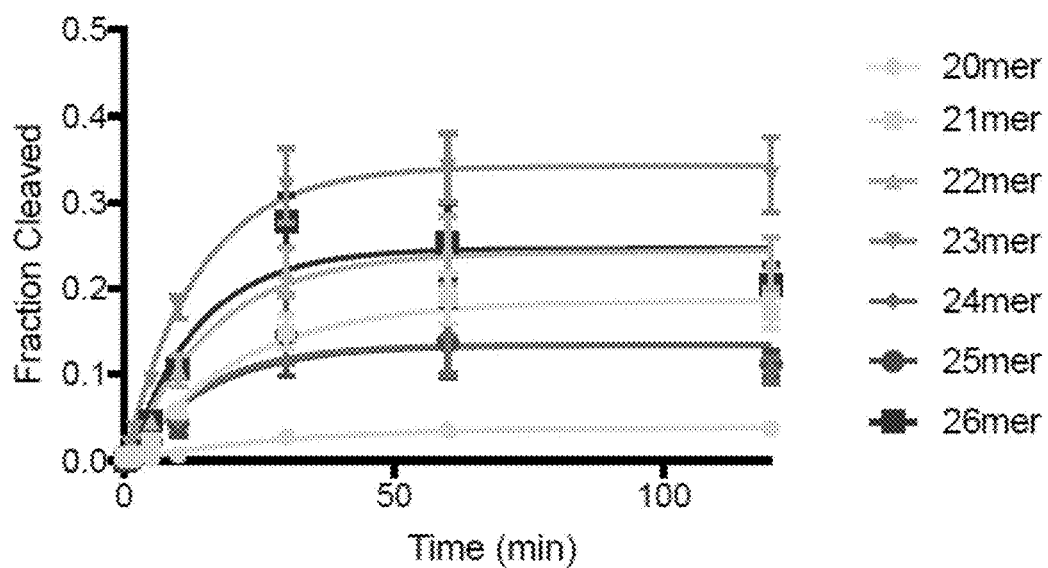
FIG. 7B
FIG. 7C

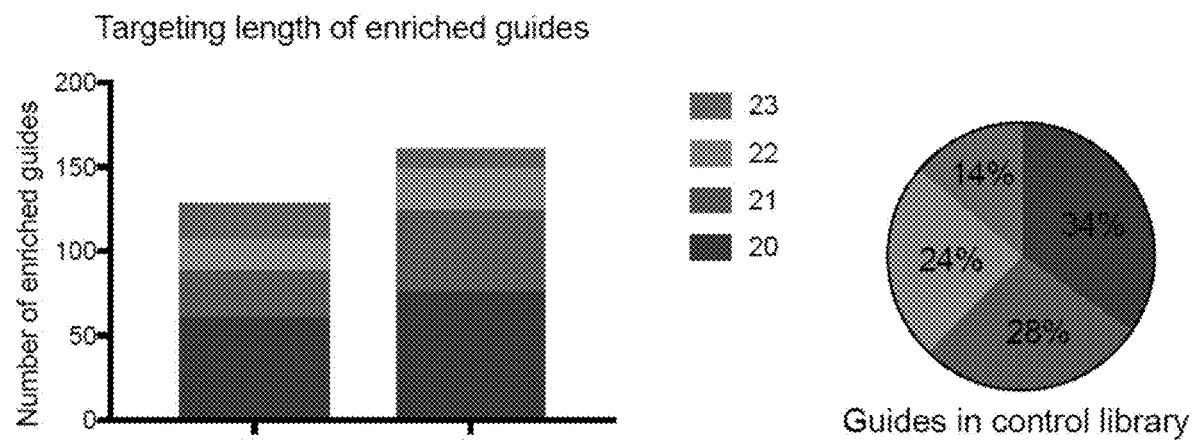
FIG. 11A
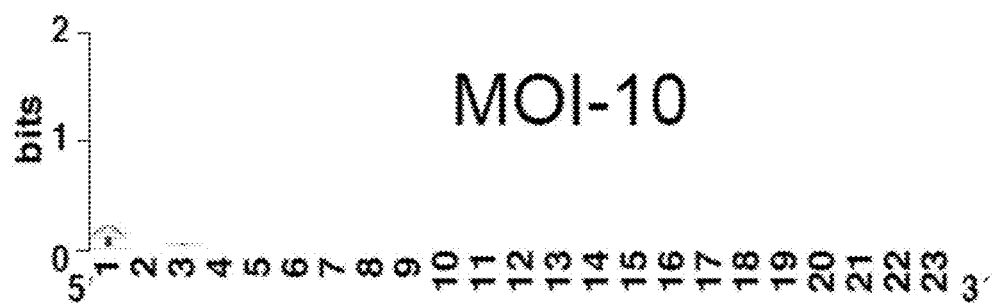
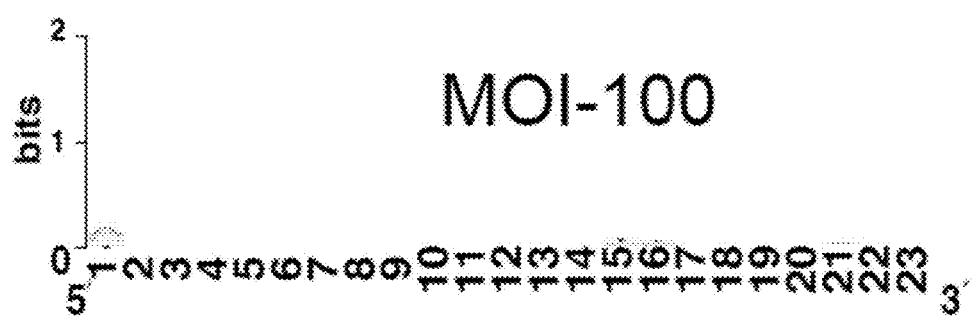
FIG. 11B

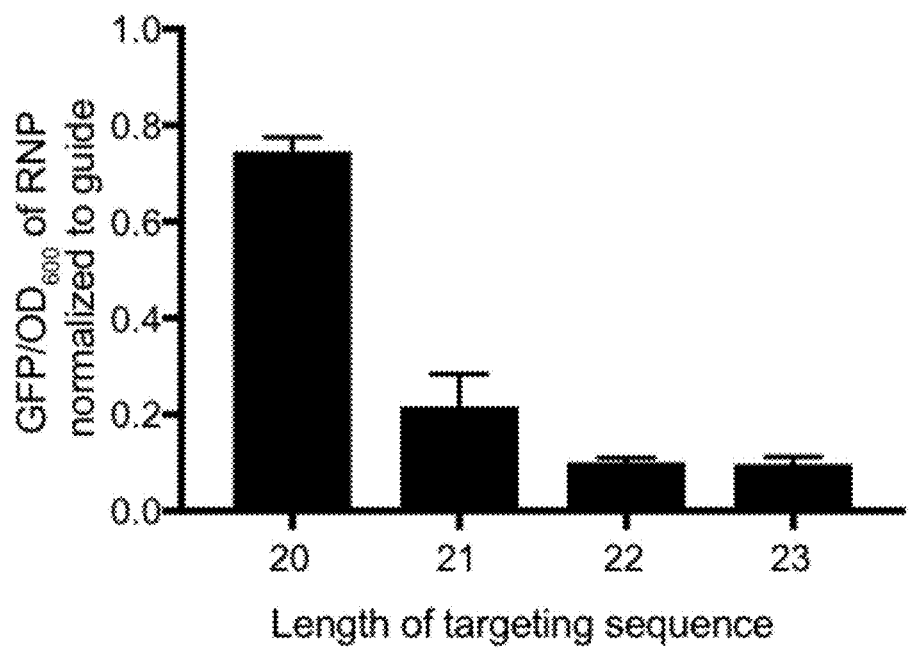
FIG. 15B
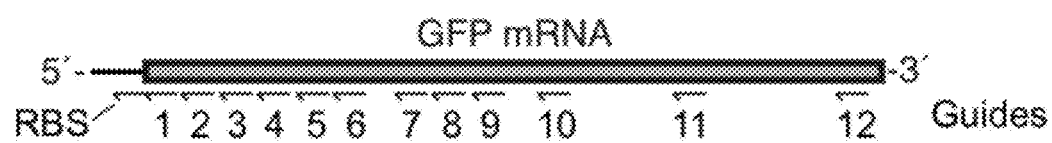
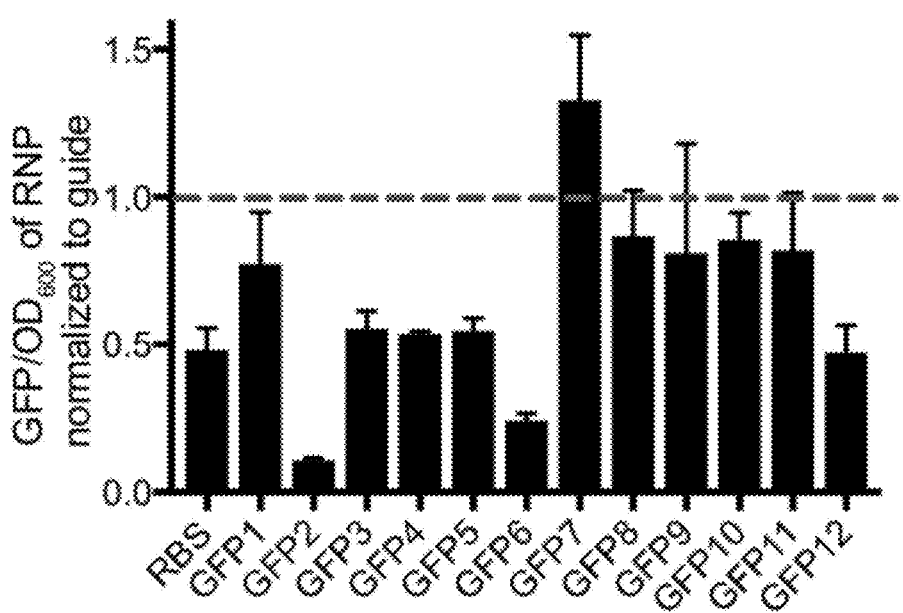
FIG. 15C

```
Wt SauCas9 (SEQ ID NO:100)
   1 MGKRNYILGL DIGITSVGYG IIDYETRDVI DAGVRLFKEA NVENNEGRRS KRGARRLKRR
  61 RRHRIQRVKK LLFDYNLLTD HSELSGINPY EARVKGLSQK LSEEEFSAAL LHLAKRRGVH
 121 NVNEVEEDTG NELSTKEQIS RNSKALEEKY VAELQLERLK KDGEVRGSIN RFKTSDYVKE
 181 AKQLLKVQKA YHQLDQSFID TYIDLLETRR TYYEGPGEGS PFGWKDIKEW YEMLMGHCTY
 241 FPEELRSVKY AYNADLYNAL NDLNNLVITR DENEKLEYYE KFQIIENVFK QKKKPTLKQI
 301 AKEILVNEED IKGYRVTSTG KPEFTNLKVY HDIKDITARK EIIENAELLD QIAKILTIYQ
 361 SSEDIQEELT NLNSELTQEE IEQISNLKGY TGTHNLSLKA INLILDELWH TNDNQIAIFN
 421 RLKLVPKKVD LSQQKEIPTT LVDDFILSPV VKRSFIQSIK VINAIIKKYG LPNDIIIELA
 481 REKNSKDAQK MINEMQKRNR QTNERIEEII RTTGKENAKY LIEKIKLHDM QEGKCLYSLE
 541 AIPLEDLLNN PFNYEVDHII PRSVSFDNSF NNKVLVKQEE NSKKGNRTPF QYLSSSDSKI
 601 SYETFKKHIL NLAKGKGRIS KTKKEYLLEE RDINRFSVQK DFINRNLVDT RYATRGLMNL
 661 LRSYFRVNNL DVKVKSINGG FTSFLRRKWK FKKERNKGYK HHAEDALIIA NADFIFKEWK
 721 KLDKAKKVME NQMFEEKQAE SMPEIETEQE YKEIFITPHQ IKHIKDFKDY KYSHRVDKKP
 781 NRELINDTLY STRKDDKGNT LIVNNLNGLY DKDNDKLKKL INKSPEKLLM YHHDPQTYQK
 841 LKLIMEQYGD EKNPLYKYYE ETGNYLTKYS KKDNGPVIKK IKYYGNKLNA HLDITDDYPN
 901 SRNKVVKLSL KPYRFDVYLD NGVYKFVTVK NLDVIKKENY YEVNSKCYEE AKKLKKISNQ
 961 AEFIASFYNN DLIKINGELY RVIGVNNDLL NRIEVNMIDI TYREYLENMN DKRPPRIIKT
1021 IASKTQSIKK YSTDILGNLY EVKSKKHPQI IKKG
```

FIG. 17A

```
dSauCas9 (SEQ ID NO:101)
   1 MGKRNYILGL AIGITSVGYG IIDYETRDVI DAGVRLFKEA NVENNEGRRS KRGARRLKRR
  61 RRHRIQRVKK LLFDYNLLTD HSELSGINPY EARVKGLSQK LSEEEFSAAL LHLAKRRGVH
 121 NVNEVEEDTG NELSTKEQIS RNSKALEEKY VAELQLERLK KDGEVRGSIN RFKTSDYVKE
 181 AKQLLKVQKA YHQLDQSFID TYIDLLETRR TYYEGPGEGS PFGWKDIKEW YEMLMGHCTY
 241 FPEELRSVKY AYNADLYNAL NDLNNLVITR DENEKLEYYE KFQIIENVFK QKKKPTLKQI
 301 AKEILVNEED IKGYRVTSTG KPEFTNLKVY HDIKDITARK EIIENAELLD QIAKILTIYQ
 361 SSEDIQEELT NLNSELTQEE IEQISNLKGY TGTHNLSLKA INLILDELWH TNDNQIAIFN
 421 RLKLVPKKVD LSQQKEIPTT LVDDFILSPV VKRSFIQSIK VINAIIKKYG LPNDIIIELA
 481 REKNSKDAQK MINEMQKRNR QTNERIEEII RTTGKENAKY LIEKIKLHDM QEGKCLYSLE
 541 AIPLEDLLNN PFNYEVDHII PRSVSFDNSF NNKVLVKQEE ASKKGNRTPF QYLSSSDSKI
 601 SYETFKKHIL NLAKGKGRIS KTKKEYLLEE RDINRFSVQK DFINRNLVDT RYATRGLMNL
 661 LRSYFRVNNL DVKVKSINGG FTSFLRRKWK FKKERNKGYK HHAEDALIIA NADFIFKEWK
 721 KLDKAKKVME NQMFEEKQAE SMPEIETEQE YKEIFITPHQ IKHIKDFKDY KYSHRVDKKP
 781 NRELINDTLY STRKDDKGNT LIVNNLNGLY DKDNDKLKKL INKSPEKLLM YHHDPQTYQK
 841 LKLIMEQYGD EKNPLYKYYE ETGNYLTKYS KKDNGPVIKK IKYYGNKLNA HLDITDDYPN
 901 SRNKVVKLSL KPYRFDVYLD NGVYKFVTVK NLDVIKKENY YEVNSKCYEE AKKLKKISNQ
 961 AEFIASFYNN DLIKINGELY RVIGVNNDLL NRIEVNMIDI TYREYLENMN DKRPPRIIKT
1021 IASKTQSIKK YSTDILGNLY EVKSKKHPQI IKKG
```

FIG. 17B

```
SpyCas9  (SEQ ID NO:102)
     1  MDKKYSIGLD IGTNSVGWAV ITDEYKVPSK KFKVLGNTDR HSIKKNLIGA LLFDSGETAE
    61  ATRLKRTARR RYTRRKNRIC YLQEIFSNEM AKVDDSFFHR LEESFLVEED KKHERHPIFG
   121  NIVDEVAYHE KYPTIYHLRK KLVDSTDKAD LRLIYLALAH MIKFRGHFLI EGDLNPDNSD
   181  VDKLFIQLVQ TYNQLFEENP INASGVDAKA ILSARLSKSR RLENLIAQLP GEKKNGLFGN
   241  LIALSLGLTP NFKSNFDLAE DAKLQLSKDT YDDDLDNLLA QIGDQYADLF LAAKNLSDAI
   301  LLSDILRVNT EITKAPLSAS MIKRYDEHHQ DLTLLKALVR QQLPEKYKEI FFDQSKNGYA
   361  GYIDGGASQE EFYKFIKPIL EKMDGTEELL VKLNREDLLR KQRTFDNGSI PHQIHLGELH
   421  AILRRQEDFY PFLKDNREKI EKILTFRIPY YVGPLARGNS RFAWMTRKSE ETITPWNFEE
   481  VVDKGASAQS FIERMTNFDK NLPNEKVLPK HSLLYEYFTV YNELTKVKYV TEGMRKPAFL
   541  SGEQKKAIVD LLFKTNRKVT VKQLKEDYFK KIECFDSVEI SGVEDRFNAS LGTYHDLLKI
   601  IKDKDFLDNE ENEDILEDIV LTLTLFEDRE MIEERLKTYA HLFDDKVMKQ LKRRRYTGWG
   661  RLSRKLINGI RDKQSGKTIL DFLKSDGFAN RNFMQLIHDD SLTFKEDIQK AQVSGQGDSL
   721  HEHIANLAGS PAIKKGILQT VKVVDELVKV MGRHKPENIV IEMARENQTT QKGQKNSRER
   781  MKRIEEGIKE LGSQILKEHP VENTQLQNEK LYLYYLQNGR DMYVDQELDI NRLSDYDVDH
   841  IVPQSFLKDD SIDNKVLTRS DKNRGKSDNV PSEEVVKKMK NYWRQLLNAK LITQRKFDNL
   901  TKAERGGLSE LDKAGFIKRQ LVETRQITKH VAQILDSRMN TKYDENDKLI REVKVITLKS
   961  KLVSDFRKDF QFYKVREINN YHHAHDAYLN AVVGTALIKK YPKLESEFVY GDYKVYDVRK
  1021  MIAKSEQEIG KATAKYFFYS NIMNFFKTEI TLANGEIRKR PLIETNGETG EIVWDKGRDF
  1081  ATVRKVLSMP QVNIVKKTEV QTGGFSKESI LPKRNSDKLI ARKKDWDPKK YGGFDSPTVA
  1141  YSVLVVAKVE KGKSKKLKSV KELLGITIME RSSFEKNPID FLEAKGYKEV KKDLIIKLPK
  1201  YSLFELENGR KRMLASAGEL QKGNELALPS KYVNFLYLAS HYEKLKGSPE DNEQKQLFVE
  1261  QHKHYLDEII EQISEFSKRV ILADANLDKV LSAYNKHRDK PIREQAENII HLFTLTNLGA
  1321  PAAFKYFDTT IDRKRYTSTK EVLDATLIHQ SITGLYETRI DLSQLGGD
```

FIG. 17C

```
FnoCas9  (SEQ ID NO:103)
     1  MNFKILPIAI DLGVKNTGVF SAFYQKGTSL ERLDNKNGKV YELSKDSYTL LMNNRTARRH
    61  QRRGIDRKQL VKRLFKLIWT EQLNLEWDKD TQQAISFLFN RRGFSFITDG YSPEYLNIVP
   121  EQVKAILMDI FDDYNGEDDL DSYLKLATEQ ESKISEIYNK LMQKILEFKL MKLCTDIKDD
   181  KVSTKTLKEI TSYEFELLAD YLANYSESLK TQKFSYTDKQ GNLKELSYYH HDKYNIQEFL
   241  KRHATINDRI LDTLLTDDLD IWNFNFEKFD FDKNEEKLQN QEDKDHIQAH LHHFVFAVNK
   301  IKSEMASGGR HRSQYFQEIT NVLDENNHQE GYLKNFCENL HNKKYSNLSV KNLVNLIGNL
   361  SNLELKPLRK YFNDKIHAKA DHWDEQKFTE TYCHWILGEW RVGVKDQDKK DGAKYSYKDL
   421  CNELKQKVTK AGLVDFLLEL DPCRTIPPYL DNNNRKPPKC QSLILNPKFL DNQYPNWQQY
   481  LQELKKLQSI QNYLDSFETD LKVLKSSKDQ PYFVEYKSSN QQIASGQRDY KDLDARILQF
   541  IFDRVKASDE LLLNEIYFQA KKLQKASSE LEKLESSKKL DEVIANSQLS QILKSQHTNG
   601  IFEQGTFLHL VCKYYKQRQR ARDSRLYIMP EYRYDKKLHK YNNTGRFDDD NQLLTYCNHK
   661  PRQKRYQLLN DLAGVLQVSP NFLKDKIGSD DDLFISKWLV EHIRGFKKAC EDSLKIQKDN
   721  RGLLNHKINI ARNTKGKCEK EIFNLICKIE GSEDKKGNYK HGLAYELGVL LFGEPNEASK
   781  PEFDRKIKKF NSIYSFAQIQ QIAFAERKGN ANTCAVCSAD NAHRMQQIKI TEPVEDNKDK
   841  IILSAKAQRL PAIPTRIVDG AVKKMATILA KNIVDDNWQN IKQVLSAKHQ LHIPIIITESN
   901  AFEFEPALAD VKGKSLKDRR KKALERISPE NIFKDKNNRI KEFAKGISAY SGANLTDGDF
   961  DGAKEELDHI IPRSHKKYGT LNDEANLICV TRGDNKNKGN RIFCLRDLAD NYKLKQFETT
  1021  DDLEIEKKIA DTIWDANKKD FKFGNYRSFI NLTPQEQKAF RHALFLADEN PIKQAVIRAI
  1081  NNRNRTFVNG TQRYFAEVLA NNIYLRAKKE NLNTDKISFD YFGIPTIGNG RGIAEIRQLY
  1141  EKVDSDIQAY AKGDKPQASY SHLIDAMLAF CIAADEHRND GSIGLEIDKN YSLYPLDKNT
  1201  GEVFTKDIFS QIKITDNEFS DKKLVRKKAI EGFNTHRQMT RDGIYAENYL PILIHKELNE
  1261  VRKGYTWKNS EEIKIFKGKK YDIQQLNNLV YCLKFVDKPI SIDIQISTLE ELRNILTTNN
  1321  IAATAEYYYI NLKTQKLHEY YIENYNTALG YKKYSKEMEF LRSLAYRSER VKIKSIDDVK
  1381  QVLDKDSNFI IGKITLPFKK EWQRLYREWQ NTTIKDDYEF LKSFFNVKSI TKLHKKVRKD
  1441  FSLPISTNEG KFLVKRKTWD NNFIYQILND SDSRADGTKP FIPAFDISKN EIVEAIIDSF
  1501  TSKNIFWLPK NIELQKVDNK NIFAIDTSKW FEVETPSDLR DIGIATIQYK IDNNSRPKVR
  1561  VKLDYVIDDD SKINYFMNHS LLKSRYPDKV LEILKQSTII EFESSGFNKT IKEMLGMKLA
  1621  GIYNETSNN
```

FIG. 17D

CjeCas9   (SEQ ID NO:104)
    1 MARILAFDIG ISSIGWAFSE NDELKDCGVR IFTKVENPKT GESLALPRRL ARSARKRLAR
   61 RKARLNHLKH LIANEFKLNY EDYQSFDESL AKAYKGSLIS PYELRFRALN ELLSKQDFAR
  121 VILHIAKRRG YDDIKNSDDK EKGAILKAIK QNEEKLANYQ SVGEYLYKEY FQKFKENSKE
  181 FTNVRNKKES YERCIAQSFL KDELKLIFKK QREFGFSFSK KFEEEVLSVA FYKRALKDFS
  241 HLVGNCSFFT DEKRAPKNSP LAFMFVALTR IINLLNNLKN TEGILYTKDD LNALLNEVLK
  301 NGTLTYKQTK KLLGLSDDYE FKGEKGTYFI EFKKYKEFIK ALGEHNLSQD DLNEIAKDIT
  361 LIKDEIKLKK ALAKYDLNQN QIDSLSKLEF KDHLNISFKA LKLVTPLMLE GKKYDEACNE
  421 LNLKVAINED KKDFLPAFNE TYYKDEVTNP VVLRAIKEYR KVLNALLKKY GKVHKINIEL
  481 AREVGKNHSQ RAKIEKEQNE NYKAKKDAEL ECEKLGLKIN SKNILKLRLF KEQKEFCAYS
  541 GEKIKISDLQ DEKMLEIDHI YPYSRSFDDS YMNKVLVFTK QNQEKLNQTP FEAFGNDSAK
  601 WQKIEVLAKN LPTKKQKRIL DKNYKDKEQK NFKDRNLNDT RYIARLVLNY TKDYLDFLPL
  661 SDDENTKLND TQKGSKVHVE AKSGMLTSAL RHTWGFSAKD RNNHLHHAID AVIIAYANNS
  721 IVKAFSDFKK EQESNSAELY AKKISELDYK NKRKFFEPFS GFRQKVLDKI DEIFVSKPER
  781 KKPSGALHEE TFRKEEEFYQ SYGGKEGVLK ALELGKIRKV NGKIVKNGDM FRVDIFKHKK
  841 TNKFYAVPIY TMDFALKVLP NKAVARSKKG EIKDWILMDE NYEFCFSLYK DSLILIQTKD
  901 MQEPEFVYYN AFTSSTVSLI VSKHDNKFET LSKNQKILFK NANEKEVIAK SIGIQNLKVF
  961 EKYIVSALGE VTKAEFRQRE DFKK

FIG. 17E

| *In vitro* sgRNAs | Sequence from 5' -> 3' | SEQ ID NO: |
|---|---|---|
| Spy | GGCUGUAAGCGGAUGCCAUAGUUUUAGAGCUAGAAAUAGCAAGUUAAAAUAAGGCUAGUCCGUUAUCAACUUGAAAAAGUGGCACCGAGUCGGUGCUUUUUU | 1 |
| Sau | GGCUGUAAGCGGAUGCCAUAUGGGUUUUAGUACUCUGGAAACAGAAUCUACUAAAACAAGGCAAAAUGCCGUGUUUAUCUCGUCAACUUGUUGGCGAGAUUUUU | 2 |
| Cje | GGCUGUAAGCGGAUGCCAUAUGUUUUAGUCCCUUUUUAAAUUUCUUUAUGGUAAAAUUAUAAUCUCAUAAGAAAUUUAAAAAGGGACUAAAAUAAAGAGUUUGCGGGACUCUGCGGGGUUACAAUCCCCUAAAACCGCUU | 3 |
| Fno | GGCUGUAAGCGGAUGCCAUAUGUUUCAGUUGCGCCGAAAGGCGCUCUGUAAUCAUUUAAAAGUAUUUUGAACGGACCUCUGUUUGACACGUCUG | 4 |
| Sau 20 | GGCTGTAAGCGGATGCCATAGTTTTAGTACTCTGGAAACAGAATCTACTAAAACAAGGCAAAATGCCGTGTTTATCTCGTCAACTTGTTGGCGAGATTTTT | 5 |
| Sau 21 | GGCTGTAAGCGGATGCCATATGTTTTAGTACTCTGGAAACAGAATCTACTAAAACAAGGCAAAATGCCGTGTTTATCTCGTCAACTTGTTGGCGAGATTTTT | 6 |
| Sau 22 | GGCTGTAAGCGGATGCCATATGGTTTTAGTACTCTGGAAACAGAATCTACTAAAACAAGGCAAAATGCCGTGTTTATCTCGTCAACTTGTTGGCGAGATTTTT | 7 |
| Sau 23 | GGCTGTAAGCGGATGCCATATGGGTTTTAGTACTCTGGAAACAGAATCTACTAAAACAAGGCAAAATGCCGTGTTTATCTCGTCAACTTGTTGGCGAGATTTTT | 8 |
| Sau 24 | GGCTGTAAGCGGATGCCATATGGTGTTTTAGTACTCTGGAAACAGAATCTACTAAAACAAGGCAAAATGCCGTGTTTATCTCGTCAACTTGTTGGCGAGATTTTT | 9 |
| Sau 25 | GGCTGTAAGCGGATGCCATATGGTTGTTTTAGTACTCTGGAAACAGAATCTACTAAAACAAGGCAAAATGCCGTGTTTATCTCGTCAACTTGTTGGCGAGATTTTT | 10 |
| Sau 26 | GGCUGUAAGCGGAUGCCAUAUGGUUGGUUUUAGUACUCUGGAAACAGAAUCUACUAAAACAAGGCAAAAUGCCGUGUUUAUCUCGUCAACUUGUUGGCGAGAUUUUU | 11 |

FIG. 18A

| In vitro targets | Sequence from 5' -> 3' | SEQ ID NO: |
|---|---|---|
| ssRNA | GGGCAGCAUUCAACCAUAUGGCAUCCGCUUACAGCCAAGCUGUGACC | 12 |
| dsRNA - TS | GGGCAGCAUUCAACCAUAUGGCAUCCGCUUACAGCCAAGCUGUGACC | 13 |
| dsRNA - NTS | GGUCACAGCUUGGCUGUAAGCGGAUGCCAUAUGGUUGAAUGCUGCCC | 14 |
| ssDNA | GGGCAGCATTCAACCATATGGCATCCGCTTACAGCCAAGCTGTGACC | 15 |
| dsDNA - TS | GGGCAGCATTCAACCATATGGCATCCGCTTACAGCCAAGCTGTGACC | 16 |
| dsDNA - NTS | GGTCACAGCTTGGCTGTAAGCGGATGCCATATGGTTGAATGCTGCCC | 17 |
| PAMmer | CCATATGGTTGAATGCTGCCC | 18 |
| unrelated DNA oligo control PAMmer | GAAGCCCTGAAAGACGCGCAG | 19 |
| NTS ssRNA | GGUCACAGCUUGGCUGUAAGCGGAUGCCAUAUGGUUGAAUGCUGCCC | 20 |
| ssRNA mutant anti-PAM | GGGCAGCCAAGUCCCAUAUGGCAUCCGCUUACAGCCAAGCUGUGACC | 21 |
| dsRNA mutant anti-PAM - TS | GGGCAGCCAAGUCCCAUAUGGCAUCCGCUUACAGCCAAGCUGUGACC | 22 |
| dsRNA mutant anti-PAM - NTS | GGUCACAGCUUGGCUGUAAGCGGAUGCCAUAUGGUUGAAUGCUGCCC | 23 |
| 2nt 3' end of guide NTS | GGUCACAGCUUGGCUGUAAGCGGAUGCCAUAUAAUUGAAUGCUGCCC | 24 |
| 6nt 3' end of guide NTS | GGUCACAGCUUGGCUGUAAGCGGAUGCCUAUAAAUUGAAUGCUGCCC | 25 |
| 12nt 3' end of guide NTS | GGUCACAGCUUGGCUGUAAGCGUUACAGUAUAAAUUGAAUGCUGCCC | 26 |
| 23nt Bubble/mutant anti-PAM NTS | GGUCACAGCUUAAUGAAUUCAAUUACAGUAUAAAUUGAAUGCUGCCC | 27 |
| 2nt 3' end of guide NTS | GGUCACAGCUUAACUGUAAGCGGAUGCCAUAUGGUUGAAUGCUGCCC | 28 |
| 6nt 3' end of guide NTS | GGUCACAGCUUAAUGAAAAGCGGAUGCCAUAUGGUUGAAUGCUGCCC | 29 |
| 12nt 3' end of guide NTS | GGUCACAGCUUAAUGAAUUCAAUAUGCCAUAUGGUUGAAUGCUGCCC | 30 |
| pUC target | GGGCAGCAUUCAACCAUAUGGCAUCCGCUUACAGCCAAGCUGUGACC | 31 |
| ON target | GGGAUUCAACCAUAUGGCAUCCGCUUACAGCCAAGCUG | 32 |
| OFF target | GGGUUUUAUUUUGGAUUUGGAAACGAGAGUUUCUGGUCAUGAA | 33 |
| GFP2 dsDNA - TS | GGGCAGCTGTCCCCATATGGCATCCGCTTACAGCCAAGCTGTGACC | 34 |
| GFP2 dsDNA - NTS | GGTCACAGCTTGGCTGTAAGCGGATGCCATATGGGGACAGCTGCCC | 35 |
| GFP4 dsDNA - TS | GGGCAGCCTGTCCCCATATGGCATCCGCTTACAGCCAAGCTGTGACC | 36 |
| GFP4 dsDNA - NTS | GGTCACAGCTTGGCTGTAAGCGGATGCCATATGGGGACAGGCTGCCC | 37 |
| GFP6 dsDNA - TS | GGGCAGCTATTTGCCATATGGCATCCGCTTACAGCCAAGCTGTGACC | 38 |
| GFP6 dsDNA - NTS | GGTCACAGCTTGGCTGTAAGCGGATGCCATATGGCAAATAGCTGCCC | 39 |

FIG. 18B

| MS2 plaque sgRNAs | Sequence from 5' -> 3' | SEQ ID NO: |
|---|---|---|
| Control | UAGACGAGCCCACCGCUUAGACGUUUUAGUACUCUGGAAACAGAAUCUACUAAAACAAGGCAAAAUGCCGUGUUUAUCUCGUCAACUUGUUGGCGAGAUUUUUU | 40 |
| 23 guide | AUCCCGGGUCCUCUCUUUAGGGGUUUUAGUACUCUGGAAACAGAAUCUACUAAAACAAGGCAAAAUGCCGUGUUUAUCUCGUCAACUUGUUGGCGAGAUUUUUU | 41 |
| 23 guide scr | GUGCUUGUCCCCAGGGUCGUAUGUUUUAGUACUCUGGAAACAGAAUCUACUAAAACAAGGCAAAAUGCCGUGUUUAUCUCGUCAACUUGUUGGCGAGAUUUUUU | 42 |
| 22 guide | GAGAAUCCCGGGUCCUCUCUUUGUUUUAGUACUCUGGAAACAGAAUCUACUAAAACAAGGCAAAAUGCCGUGUUUAUCUCGUCAACUUGUUGGCGAGAUUUUUU | 43 |
| 22 guide scr | GACUCUGCUUGCUGGCACUACUGUUUUAGUACUCUGGAAACAGAAUCUACUAAAACAAGGCAAAAUGCCGUGUUUAUCUCGUCAACUUGUUGGCGAGAUUUUUU | 44 |
| 23 (supp) | ACUUCGCUUGUAGGCACCUUGAUGUUUUAGUACUCUGGAAACAGAAUCUACUAAAACAAGGCAAAAUGCCGUGUUUAUCUCGUCAACUUGUUGGCGAGAUUUUUU | 45 |
| 22 (supp) | AUUCAUAUCAGGCUCCUUACAGGUUUUAGUACUCUGGAAACAGAAUCUACUAAAACAAGGCAAAAUGCCGUGUUUAUCUCGUCAACUUGUUGGCGAGAUUUUUU | 46 |
| 21 (supp) | GAGGUCCCUGGGCCGAAGCCCGUUUUAGUACUCUGGAAACAGAAUCUACUAAAACAAGGCAAAAUGCCGUGUUUAUCUCGUCAACUUGUUGGCGAGAUUUUUU | 47 |
| 20 (supp) | UUCGAUGUAAGUCAAGUUUUGUUUUAGUACUCUGGAAACAGAAUCUACUAAAACAAGGCAAAAUGCCGUGUUUAUCUCGUCAACUUGUUGGCGAGAUUUUUU | 48 |
| 14238 | UAUACCGCUUUCAGUUUUCAUUGUUUUAGUACUCUGGAAACAGAAUCUACUAAAACAAGGCAAAAUGCCGUGUUUAUCUCGUCAACUUGUUGGCGAGAUUUUUU | 49 |
| 14238 scr | GUUCUAUUCUUCAUUUCGUUACAGUUUUAGUACUCUGGAAACAGAAUCUACUAAAACAAGGCAAAAUGCCGUGUUUAUCUCGUCAACUUGUUGGCGAGAUUUUUU | 50 |
| 14210 | UACGGACCGGCUCAGGGAAUUGUUUUAGUACUCUGGAAACAGAAUCUACUAAAACAAGGCAAAAUGCCGUGUUUAUCUCGUCAACUUGUUGGCGAGAUUUUUU | 51 |
| 14210 scr | GGCAUGCGACGUGGAACUCUAUGUUUUAGUACUCUGGAAACAGAAUCUACUAAAACAAGGCAAAAUGCCGUGUUUAUCUCGUCAACUUGUUGGCGAGAUUUUUU | 52 |

FIG. 18C

| GFP sgRNAs | Sequence from 5' -> 3' | SEQ ID NO: |
|---|---|---|
| RBS | CAUGGUACCUUUCUCCUCUUUAAGUUUUAGUACUCUGGAAACAGAAUCUACUAAAACAAGGCAAAAUGCCGUGUUUAUCUCGUCAACUUGUUGGCGAGAUUUUUU | 53 |
| GFP1 | CCAGUGAAAAGUUCUUCUCCUUUGUUUUAGUACUCUGGAAACAGAAUCUACUAAAACAAGGCAAAAUGCCGUGUUUAUCUCGUCAACUUGUUGGCGAGAUUUUUU | 54 |
| GFP2 | CACCAUCUAAUUCAACAAGAAUUGUUUUAGUACUCUGGAAACAGAAUCUACUAAAACAAGGCAAAAUGCCGUGUUUAUCUCGUCAACUUGUUGGCGAGAUUUUUU | 55 |
| GFP3 | CAGAAAAUUUGUGCCCAUUAACAGUUUUAGUACUCUGGAAACAGAAUCUACUAAAACAAGGCAAAAUGCCGUGUUUAUCUCGUCAACUUGUUGGCGAGAUUUUUU | 56 |
| GFP4 | AGCAUCACCUUCACCCUCUCCACGUUUUAGUACUCUGGAAACAGAAUCUACUAAAACAAGGCAAAAUGCCGUGUUUAUCUCGUCAACUUGUUGGCGAGAUUUUUU | 57 |
| GFP5 | AAUUUAAGGGUGAGUUUUCCGUUGUUUUAGUACUCUGGAAACAGAAUCUACUAAAACAAGGCAAAAUGCCGUGUUUAUCUCGUCAACUUGUUGGCGAGAUUUUUU | 58 |
| GFP6 | GAACAGGUAGUUUUCCAGUAGUGGUUUUAGUACUCUGGAAACAGAAUCUACUAAAACAAGGCAAAAUGCCGUGUUUAUCUCGUCAACUUGUUGGCGAGAUUUUUU | 59 |
| GFP7 | CGGGCAUGGCACUCUUGAAAAAGGUUUUAGUACUCUGGAAACAGAAUCUACUAAAACAAGGCAAAAUGCCGUGUUUAUCUCGUCAACUUGUUGGCGAGAUUUUUU | 60 |
| GFP8 | AAAGAUAUAGUGCGUUCCUGUACGUUUUAGUACUCUGGAAACAGAAUCUACUAAAACAAGGCAAAAUGCCGUGUUUAUCUCGUCAACUUGUUGGCGAGAUUUUUU | 61 |
| GFP9 | ACGCGUCUUGUAGGUCCCGUCAUGUUUUAGUACUCUGGAAACAGAAUCUACUAAAACAAGGCAAAAUGCCGUGUUUAUCUCGUCAACUUGUUGGCGAGAUUUUUU | 62 |
| GFP10 | UUUAAAAUCAAUACCCUUUAACUGUUUUAGUACUCUGGAAACAGAAUCUACUAAAACAAGGCAAAAUGCCGUGUUUAUCUCGUCAACUUGUUGGCGAGAUUUUUU | 63 |
| GFP11 | GUUGAACGGAACCAUCUUCAACGGUUUUAGUACUCUGGAAACAGAAUCUACUAAAACAAGGCAAAAUGCCGUGUUUAUCUCGUCAACUUGUUGGCGAGAUUUUUU | 64 |
| GFP12 | AUGUGUAAUCCCAGCAGCAGUUAGUUUUAGUACUCUGGAAACAGAAUCUACUAAAACAAGGCAAAAUGCCGUGUUUAUCUCGUCAACUUGUUGGCGAGAUUUUUU | 65 |
| 20mer | CACCAUCUAAUUCAACAAGAAUUGUUUUAGUACUCUGGAAACAGAAUCUACUAAAACAAGGCAAAAUGCCGUGUUUAUCUCGUCAACUUGUUGGCGAGAUUUUUU | 66 |
| 21mer | CACCAUCUAAUUCAACAAGAAUGUUUUAGUACUCUGGAAACAGAAUCUACUAAAACAAGGCAAAAUGCCGUGUUUAUCUCGUCAACUUGUUGGCGAGAUUUUUU | 67 |
| 22mer | CACCAUCUAAUUCAACAAGAAGUUUUAGUACUCUGGAAACAGAAUCUACUAAAACAAGGCAAAAUGCCGUGUUUAUCUCGUCAACUUGUUGGCGAGAUUUUUU | 68 |
| 23mer | CACCAUCUAAUUCAACAAGAGUUUUAGUACUCUGGAAACAGAAUCUACUAAAACAAGGCAAAAUGCCGUGUUUAUCUCGUCAACUUGUUGGCGAGAUUUUUU | 69 |
| GFP2 noncoding | AAUUCUUGUUGAAUUAGAUGGUGGUUUUAGUACUCUGGAAACAGAAUCUACUAAAACAAGGCAAAAUGCCGUGUUUAUCUCGUCAACUUGUUGGCGAGAUUUUUU | 70 |
| GFP6 noncoding | CACUACUGGAAAACUACCUGUUCGUUUUAGUACUCUGGAAACAGAAUCUACUAAAACAAGGCAAAAUGCCGUGUUUAUCUCGUCAACUUGUUGGCGAGAUUUUUU | 71 |

FIG. 18D

| GFP repression targets | Sequence from 5' -> 3' | SEQ ID NO: |
|---|---|---|
| Spy PAM adjacent | AATTCTTGTTGAATTAGATGGTGA | 72 |
| None PAM adjacent | CACTACTGGAAAACTACCTGTTC | 73 |
| Sau PAM adjacent | ACCTATGGTGTTCAATGCTTTTC | 74 |
| Dual PAM adjacent | ATTGGCGATGGCCCTGTCCTTTT | 75 |
| GFP gene | ATGAGCAAAGGAGAAGAACTTTTCACTGGAGTTGTCCCAATTCTTGTTGAATTAGATGGTGATGTTAATGGGCACAAATTTTCTGTCCGTGGAGAGGGTGAAGGTGATGCTACAAACGGAAAACTCACCCTTAAATTTATTTGCACTACTGGAAAACTACCTGTTCCGTGGCCAACACTTGTCACTACTCTGACCTATGGTGTTCAATGCTTTTCCCGTTATCCGGATCACATGAAACGGCATGACTTTTTCAAGAGTGCCATGCCCGAAGGTTATGTACAGGAACGCACTATATCTTTCAAAGATGACGGGACCTACAAGACGCGTGCTGAAGTCAAGTTTGAAGGTGATACCCTTGTTAATCGTATCGAGTTAAAGGGTATTGATTTTAAAGAAGATGGAAACATTCTTGGACACAAACTCGAGTACAACTTTAACTCACACAATGTATACATCACGGCAGACAAACAAAAGAATGGAATCAAAGCTAACTTCAAAATTCGCCACAACGTTGAAGATGGTTCCGTTCAACTAGCAGACCATTATCAACAAAATACTCCAATTGGCGATGGCCCTGTCCTTTTACCAGACAACCATTACCTGTCGACACAATCTGTCCTTTCGAAAGATCCCAACGAAAAGCGTGACCACATGGTCCTTCTTGAGTTTGTAACTGCTGCTGGGATTACACATGGCATGGATGAGCTCTACAAA | 76 |

FIG. 18E

*Staphylococcus aureus* Cas9 (UniProtKB J7RUA5, SEQ ID NO:110)
```
   1  MKRNYILGLD  IGITSVGYGI  IDYETRDVID  AGVRLFKEAN  VENNEGRRSK  RGARRLKRRR
  61  RHRIQRVKKL  LFDYNLLTDH  SELSGINPYE  ARVKGLSQKL  SEEEFSAALL  HLAKRRGVHN
 121  VNEVEEDTGN  ELSTKEQISR  NSKALEEKYV  AELQLERLKK  DGEVRGSINR  FKTSDYVKEA
 181  KQLLKVQKAY  HQLDQSFIDT  YIDLLETRRT  YYEGPGEGSP  FGWKDIKEWY  EMLMGHCTYF
 241  PEELRSVKYA  YNADLYNALN  DLNNLVITRD  ENEKLEYYEK  FQIIENVFKQ  KKKPTLKQIA
 301  KEILVNEEDI  KGYRVTSTGK  PEFTNLKVYH  DIKDITARKE  IIENAELLDQ  IAKILTIYQS
 361  SEDIQEELTN  LNSELTQEEI  EQISNLKGYT  GTHNLSLKAI  NLILDELWHT  NDNQIAIFNR
 421  LKLVPKKVDL  SQQKEIPTTL  VDDFILSPVV  KRSFIQSIKV  INAIIKKYGL  PNDIIIELAR
 481  EKNSKDAQKM  INEMQKRNRQ  TNERIEEIIR  TTGKENAKYL  IEKIKLHDMQ  EGKCLYSLEA
 541  IPLEDLLNNP  FNYEVDHIIP  RSVSFDNSFN  NKVLVKQEEN  SKKGNRTPFQ  YLSSSDSKIS
 601  YETFKKHILN  LAKGKGRISK  TKKEYLLEER  DINRFSVQKD  FINRNLVDTR  YATRGLMNLL
 661  RSYFRVNNLD  VKVKSINGGF  TSFLRRKWKF  KKERNKGYKH  HAEDALIIAN  ADFIFKEWKK
 721  LDKAKKVMEN  QMFEEKQAES  MPEIETEQEY  KEIFITPHQI  KHIKDFKDYK  YSHRVDKKPN
 781  RELINDTLYS  TRKDDKGNTL  IVNNLNGLYD  KDNDKLKKLI  NKSPEKLLMY  HHDPQTYQKL
 841  KLIMEQYGDE  KNPLYKYYEE  TGNYLTKYSK  KDNGPVIKKI  KYYGNKLNAH  LDITDDYPNS
 901  RNKVVKLSLK  PYRFDVYLDN  GVYKFVTVKN  LDVIKKENYY  EVNSKCYEEA  KKLKKISNQA
 961  EFIASFYNND  LIKINGELYR  VIGVNNDLLN  RIEVNMIDIT  YREYLENMND  KRPPRIIKTI
1021  ASKTQSIKKY  STDILGNLYE  VKSKKHPQII  KKG
```

FIG. 19A

*Campylobacter jejuni* subsp. *jejuni* serotype O:2 Cas9 (UniProtKB Q0P897, SEQ ID NO:111)
```
   1  MARILAFDIG  ISSIGWAFSE  NDELKDCGVR  IFTKVENPKT  GESLALPRRL  ARSARKRLAR
  61  RKARLNHLKH  LIANEFKLNY  EDYQSFDESL  AKAYKGSLIS  PYELRFRALN  ELLSKQDFAR
 121  VILHIAKRRG  YDDIKNSDDK  EKGAILKAIK  QNEEKLANYQ  SVGEYLYKEY  FQKFKENSKE
 181  FTNVRNKKES  YERCIAQSFL  KDELKLIFKK  QREFGFSFSK  KFEEEVLSVA  FYKRALKDFS
 241  HLVGNCSFFT  DEKRAPKNSP  LAFMFVALTR  IINLLNNLKN  TEGILYTKDD  LNALLNEVLK
 301  NGTLTYKQTK  KLLGLSDDYE  FKGEKGTYFI  EFKKYKEFIK  ALGEHNLSQD  DLNEIAKDIT
 361  LIKDEIKLKK  ALAKYDLNQN  QIDSLSKLEF  KDHLNISFKA  LKLVTPLMLE  GKKYDEACNE
 421  LNLKVAINED  KKDFLPAFNE  TYYKDEVTNP  VVLRAIKEYR  KVLNALLKKY  GKVHKINIEL
 481  AREVGKNHSQ  RAKIEKEQNE  NYKAKKDAEL  ECEKLGLKIN  SKNILKLRLF  KEQKEFCAYS
 541  GEKIKISDLQ  DEKMLEIDHI  YPYSRSFDDS  YMNKVLVFTK  QNQEKLNQTP  FEAFGNDSAK
 601  WQKIEVLAKN  LPTKKQKRIL  DKNYKDKEQK  NFKDRNLNDT  RYIARLVLNY  TKDYLDFLPL
 661  SDDENTKLND  TQKGSKVHVE  AKSGMLTSAL  RHTWGFSAKD  RNNHLHHAID  AVIIAYANNS
 721  IVKAFSDFKK  EQESNSAELY  AKKISELDYK  NRKFFEPFS  GFRQKVLDKI  DEIFVSKPER
 781  KKPSGALHEE  TFRKEEEFYQ  SYGGKEGVLK  ALELGKIRKV  NGKIVKNGDM  FRVDIFKHKK
 841  TNKFYAVPIY  TMDFALKVLP  NKAVARSKKG  EIKDWILMDE  NYEFCFSLYK  DSLILIQTKD
 901  MQEPEFVYYN  AFTSSTVSLI  VSKHDNKFET  LSKNQKILFK  NANEKEVIAK  SIGIQNLKVF
 961  EKYIVSALGE  VTKAEFRQRE  DFKK
```

FIG. 19B

*Streptococcus thermophilus* Cas9 (UniProtKB G3ECR1, SEQ ID NO:112)

```
   1 MLFNKCIIIS INLDFSNKEK CMTKPYSIGL DIGTNSVGWA VITDNYKVPS KKMKVLGNTS
  61 KKYIKKNLLG VLLFDSGITA EGRRLKRTAR RRYTRRRNRI LYLQEIFSTE MATLDDAFFQ
 121 RLDDSFLVPD DKRDSKYPIF GNLVEEKVYH DEFPTIYHLR KYLADSTKKA DLRLVYLALA
 181 HMIKYRGHFL IEGEFNSKNN DIQKNFQDFL DTYNAIFESD LSLENSKQLE EIVKDKISKL
 241 EKKDRILKLF PGEKNSGIFS EFLKLIVGNQ ADFRKCFNLD EKASLHFSKE SYDEDLETLL
 301 GYIGDDYSDV FLKAKKLYDA ILLSGFLTVT DNETEAPLSS AMIKRYNEHK EDLALLKEYI
 361 RNISLKTYNE VFKDDTKNGY AGYIDGKTNQ EDFYVYLKNL LAEFEGADYF LEKIDREDFL
 421 RKQRTFDNGS IPYQIHLQEM RAILDKQAKF YPFLAKNKER IEKILTFRIP YYVGPLARGN
 481 SDFAWSIRKR NEKITPWNFE DVIDKESSAE AFINRMTSFD LYLPEEKVLP KHSLLYETFN
 541 VYNELTKVRF IAESMRDYQF LDSKQKKDIV RLYFKDKRKV TDKDIIEYLH AIYGYDGIEL
 601 KGIEKQFNSS LSTYHDLLNI INDKEFLDDS SNEAIIEEII HTLTIFEDRE MIKQRLSKFE
 661 NIFDKSVLKK LSRRHYTGWG KLSAKLINGI RDEKSGNTIL DYLIDDGISN RNFMQLIHDD
 721 ALSFKKKIQK AQIIGDEDKG NIKEVVKSLP GSPAIKKGIL QSIKIVDELV KVMGGRKPES
 781 IVVEMARENQ YTNQGKSNSQ QRLKRLEKSL KELGSKILKE NIPAKLSKID NNALQNDRLY
 841 LYYLQNGKDM YTGDDLDIDR LSNYDIDHII PQAFLKDNSI DNKVLVSSAS NRGKSDDFPS
 901 LEVVKKRKTF WYQLLKSKLI SQRKFDNLTK AERGGLLPED KAGFIQRQLV ETRQITKHVA
 961 RLLDEKFNNK KDENNRAVRT VKIITLKSTL VSQFRKDFEL YKVREINDFH HAHDAYLNAV
1021 IASALLKKYP KLEPEFVYGD YPKYNSFRER KSATEKVYFY SNIMNIFKKS ISLADGRVIE
1081 RPLIEVNEET GESVWNKESD LATVRRVLSY PQVNVVKKVE EQNHGLDRGK PKGLFNANLS
1141 SKPKPNSNEN LVGAKEYLDP KKYGGYAGIS NSFAVLVKGT IEKGAKKKIT NVLEFQGISI
1201 LDRINYRKDK LNFLLEKGYK DIELIIELPK YSLFELSDGS RRMLASILST NNKRGEIHKG
1261 NQIFLSQKFV KLLYHAKRIS NTINENHRKY VENHKKEFEE LFYYILEFNE NYVGAKKNGK
1321 LLNSAFQSWQ NHSIDELCSS FIGPTGSERK GLFELTSRGS AADFEFLGVK IPRYRDYTPS
1381 SLLKDATLIH QSVTGLYETR IDLAKLGEG
```

FIG. 19C

*Streptococcus thermophilus* (strain ATCC BAA-491 / LMD-9) Cas9-1 (UniProtKB Q03LF7, SEQ ID NO:113)

```
   1 MSDLVLGLDI GIGSVGVGIL NKVTGEIIHK NSRIFPAAQA ENNLVRRTNR QGRRLARRKK
  61 HRRVRLNRLF EESGLITDFT KISINLNPYQ LRVKGLTDEL SNEELFIALK NMVKHRGISY
 121 LDDASDDGNS SVGDYAQIVK ENSKQLETKT PGQIQLERYQ TYGQLRGDFT VEKDGKKHRL
 181 INVFPTSAYR SEALRILQTQ QEFNPQITDE FINRYLEILT GKRKYYHGPG NEKSRTDYGR
 241 YRTSGETLDN IFGILIGKCT FYPDEFRAAK ASYTAQEFNL LNDLNNLTVP TETKKLSKEQ
 301 KNQIINYVKN EKAMGPAKLF KYIAKLLSCD VADIKGYRID KSGKAEIHTF EAYRKMKTLE
 361 TLDIEQMDRE TLDKLAYVLT LNTEREGIQE ALEHEFADGS FSQKQVDELV QFRKANSSIF
 421 GKGWHNFSVK LMMELIPELY ETSEEQMTIL TRLGKQKTTS SSNKTKYIDE KLLTEEIYNP
 481 VVAKSVRQAI KIVNAAIKEY GDFDNIVIEM ARETNEDDEK KAIQKIQKAN KDEKDAAMLK
 541 AANQYNGKAE LPHSVFHGHK QLATKIRLWH QQGERCLYTG KTISIHDLIN NSNQFEVDHI
 601 LPLSITFDDS LANKVLVYAT ANQEKGQRTP YQALDSMDDA WSFRELKAFV RESKTLSNKK
 661 KEYLLTEEDI SKFDVRKKFI ERNLVDTRYA SRVVLNALQE HFRAHKIDTK VSVVRGQFTS
 721 QLRRHWGIEK TRDTYHHAV DALIIAASSQ LNLWKKQKNT LVSYSEDQLL DIETGELISD
 781 DEYKESVFKA PYQHFVDTLK SKEFEDSILF SYQVDSKFNR KISDATIYAT RQAKVGKDKA
 841 DETYVLGKIK DIYTQDGYDA FMKIYKKDKS KFLMYRHDPQ TFEKVIEPIL ENYPNKQINE
 901 KGKEVPCNPF LKYKEEHGYI RKYSKKGNGP EIKSLKYYDS KLGNHIDITP KDSNNKVVLQ
 961 SVSPWRADVY FNKTTGKYEI LGLKYADLQF EKGTGTYKIS QEKYNDIKKK EGVDSDSEFK
1021 FTLYKNDLLL VKDTETKEQQ LFRFLSRTMP KQKHYVELKP YDKQKFEGGE ALIKVLGNVA
1081 NSGQCKKGLG KSNISIYKVR TDVLGNQHII KNEGDKPKLD F
```

FIG. 19D

*Streptococcus thermophilus* (strain ATCC BAA-491 / LMD-9) Cas9-2 (UniProtKB Q03JI6, SEQ ID NO:114)

```
   1 MTKPYSIGLD IGTNSVGWAV TTDNYKVPSK KMKVLGNTSK KYIKKNLLGV LLFDSGITAE
  61 GRRLKRTARR RYTRRRNRIL YLQEIFSTEM ATLDDAFFQR LDDSFLVPDD KRDSKYPIFG
 121 NLVEEKAYHD EFPTIYHLRK YLADSTKKAD LRLVYLALAH MIKYRGHFLI EGEFNSKNND
 181 IQKNFQDFLD TYNAIFESDL SLENSKQLEE IVKDKISKLE KKDRILKLFP GEKNSGIFSE
 241 FLKLIVGNQA DFRKCFNLDE KASLHFSKES YDEDLETLLG YIGDDYSDVF LKAKKLYDAI
 301 LLSGFLTVTD NETEAPLSSA MIKRYNEHKE DLALLKEYIR NISLKTYNEV FKDDTKNGYA
 361 GYIDGKTNQE DFYVYLKKLL AEFEGADYFL EKIDREDFLR KQRTFDNGSI PYQIHLQEMR
 421 AILDKQAKFY PFLAKNKERI EKILTFRIPY YVGPLARGNS DFAWSIRKRN EKITPWNFED
 481 VIDKESSAEA FINRMTSFDL YLPEEKVLPK HSLLYETFNV YNELTKVRFI AESMRDYQFL
 541 DSKQKKDIVR LYFKDKRKVT DKDIIEYLHA IYGYDGIELK GIEKQFNSSL STYHDLLNII
 601 NDKEFLDDSS NEAIIEEIIH TLTIFEDREM IKQRLSKFEN IFDKSVLKKL SRRHYTGWGK
 661 LSAKLINGIR DEKSGNTILD YLIDDGISNR NFMQLIHDDA LSFKKKIQKA QIIGDEDKGN
 721 IKEVVKSLPG SPAIKKGILQ SIKIVDELVK VMGGRKPESI VVEMARENQY TNQGKSNSQQ
 781 RLKRLEKSLK ELGSKILKEN IPAKLSKIDN NALQNDRLYL YYLQNGKDMY TGDDLDIDRL
 841 SNYDIDHIIP QAFLKDNSID NKVLVSSASN RGKSDDVPSL EVVKKRKTFW YQLLKSKLIS
 901 QRKFDNLTKA ERGGLSPEDK AGFIQRQLVE TRQITKHVAR LLDEKFNNKK DENNRAVRTV
 961 KIITLKSTLV SQFRKDFELY KVREINDFHH AHDAYLNAVV ASALLKKYPK LEPEFVYGDY
1021 PKYNSFRERK SATEKVYFYS NIMNIFKKSI SLADGRVIER PLIEVNEETG ESVWNKESDL
1081 ATVRRVLSYP QVNVVKKVEE QNHGLDRGKP KGLFNANLSS KPKPNSNENL VGAKEYLDPK
1141 KYGGYAGISN SFTVLVKTI EKGAKKKITN VLEFQGISIL DRINYRKDKL NFLLEKGYKD
1201 IELIIELPKY SLFELSDGSR RMLASILSTN NKRGEIHKGN QIFLSQKFVK LLYHAKRISN
1261 TINENHRKYV ENHKKEFEEL FYYILEFNEN YVGAKKNGKL LNSAFQSWQN HSIDELCSSF
1321 IGPTGSERKG LFELTSRGSA ADFEFLGVKI PRYRDYTPSS LLKDATLIHQ SVTGLYETRI
1381 DLAKLGEG
```

FIG. 19E

*Wolinella succinogenes* Cas9 (UniProtKB Q7MRD3, SEQ ID NO:115)

```
   1 MIERILGVDL GISSLGWAIV EYDKDDEAAN RIIDCGVRLF TAAETPKKKE SPNKARREAR
  61 GIRRVLNRRR VRMNMIKKLF LRAGLIQDVD LDGEGGMFYS KANRADVWEL RHDGLYRLLK
 121 GDELARVLIH IAKHRGYKFI GDDEADEESG KVKKAGVVLR QNFEAAGCRT VGEWLWRERG
 181 ANGKKRNKHG DYEISIHRDL LVEEVEAIFV AQQEMRSTIA TDALKAAYRE IAFFVRPMQR
 241 IEKMVGHCTY FPEERRAPKS APTAEKFIAI SKFFSTVIID NEGWEQKIIE RKTLEELLDF
 301 AVSREKVEFR HLRKFLDLSD NEIFKGLHYK GKPKTAKKRE ATLFDPNEPT ELEFDKVEAE
 361 KKAWISLRGA AKLREALGNE FYGRFVALGK HADEATKILT YYKDEGQKRR ELTKLPLEAE
 421 MVERLVKIGF SDFLKLSLKA IRDILPAMES GARYDEAVLM LGVPHKEKSA ILPPLNKTDI
 481 DILNPTVIRA FAQFRKVANA LVRKYGAFDR VHFELAREIN TKGEIEDIKE SQRKNEKERK
 541 EAADWIAETS FQVPLTRKNI LKKRLYIQQD GRCAYTGDVI ELERLFDEGY CEIDHILPRS
 601 RSADDSFANK VLCLARANQQ KTDRTPYEWF GHDAARWNAF ETRTSAPSNR VRTGKGKIDR
 661 LLKKNFDENS EMAFKDRNLN DTRYMARAIK TYCEQYWVFK NSHTKAPVQV RSGKLTSVLR
 721 YQWGLESKDR ESHTHHAVDA IIIAFSTQGM VQKLSEYYRF KETHREKERP KLAVPLANFR
 781 DAVEEATRIE NTETVKEGVE VKRLLISRPP RARVTGQAHE QTAKPYPRIK QVKNKKKWRL
 841 APIDEEKFES FKADRVASAN QKNFYETSTI PRVDVYHKKG KFHLVPIYLH EMVLNELPNL
 901 SLGTNPEAMD ENFFKFSIFK DDLISIQTQG TPKKPAKIIM GYFKNMHGAN MVLSSINNSP
 961 CEGFTCTPVS MDKKHKDKCK LCPEENRIAG RCLQGFLDYW SQEGLRPPRK EFECDQGVKF
1021 ALDVKKYQID PLGYYYEVKQ EKRLGTIPQM RSAKKLVKK
```

FIG. 19F

```
Wolinella succinogenes Cas9/Csx12 (NCBI WP_011139431.1, SEQ ID NO:116)
   1 MLVSPISVDL GGKNTGFFSF TDSLDNSQSG TVIYDESFVL SQVGRRSKRH SKRNNLRNKL
  61 VKRLFLLILQ EHHGLSIDVL PDEIRGLFNK RGYTYAGFEL DEKKKDALES DTLKEFLSEK
 121 LQSIDRDSDV EDFLNQIASN AESFKDYKKG FEAVFASATH SPNKKLELKD ELKSEYGENA
 181 KELLAGLRVT KEILDEFDKQ ENQGNLPRAK YFEELGEYIA TNEKVKSFFD SNSLKLTDMT
 241 KLIGNISNYQ LKELRRYFND KEMEKGDIWI PNKLHKITER FVRSWHPKND ADRQRRAELM
 301 KDLKSKEIME LLTTTEPVMT IPPYDDMNNR GAVKCQTLRL NEEYLDKHLP NWRDIAKRLN
 361 HGKFNDDLAD STVKGYSEDS TLLHRLLDTS KEIDIYELRG KKPNELLVKT LGQSDANRLY
 421 GFAQNYYELI RQKVRAGIWV PVKNKDDSLN LEDNSNMLKR CNHNPPHKKN QIHNLVAGIL
 481 GVKLDEAKFA EFEKELWSAK VGNKKLSAYC KNIEELRKTH GNTFKIDIEE LRKKDPAELS
 541 KEEKAKLRLT DDVILNEWSQ KIANFFDIDD KHRQRFNNLF SMAQLHTVID TPRSGFSSTC
 601 KRCTAENRFR SETAFYNDET GEFHKKATAT CQRLPADTQR PFSGKIERYI DKLGYELAKI
 661 KAKELEGMEA KEIKVPIILE QNAFEYEESL RKSKTGSNDR VINSKKDRDG KKLAKAKENA
 721 EDRLKDKDKR IKAFSSGICP YCGDTIGDDG EIDHILPRSH TLKIYGTVFN PEGNLIYVHQ
 781 KCNQAKADSI YKLSDIKAGV SAQWIEEQVA NIKGYKTFSV LSAEQQKAFR YALFLQNDNE
 841 AYKKVVDWLR TDQSARVNGT QKYLAKKIQE KLTKMLPNKH LSFEFILADA TEVSELRRQY
 901 ARQNPLLAKA EKQAPSSHAI DAVMAFVARY QKVFKDGTPP NADEVAKLAM LDSWNPASNE
 961 PLTKGLSTNQ KIEKMIKSGD YGQKNMREVF GKSIFGENAI GERYKPIVVQ EGGYYIGYPA
1021 TVKKGYELKN CKVVTSKNDI AKLEKIIKNQ DLISLKENQY IKIFSINKQT ISELSNRYFN
1081 MNYKNLVERD KEIVGLLEFI VENCRYYTKK VDVKFAPKYI HETKYPFYDD WRRFDEAWRY
1141 LQENQNKTSS KDRFVIDKSS LNEYYQPDKN EYKLDVDTQP IWDDFCRWYF LDRYKTANDK
1201 KSIRIKARKT FSLLAESGVQ GKVFRAKRKI PTGYAYQALP MDNNVIAGDY ANILLEANSK
1261 TLSLVPKSGI SIEKQLDKKL DVIKKTDVRG LAIDNNSFFN ADFDTHGIRL IVENTSVKVG
1321 NFPISAIDKS AKRMIFRALF EKEKGKRKKK TTISFKESGP VQDYLKVFLK KIVKIQLRTD
1381 GSISNIVVRK NAADFTLSFR SEHIQKLLK
```

FIG. 19G

```
Staphylococcus lugdunensis Cas9(UniProtKB A0A133QCR3, SEQ ID NO:117)
   1 MNQKFILGLD IGITSVGYGL IDYETKNIID AGVRLFPEAN VENNEGRRSK RGSRRLKRRR
  61 IHRLERVKKL LEDYNLLDQS QIPQSTNPYA IRVKGLSEAL SKDELVIALL HIAKRRGIHK
 121 IDVIDSNDDV GNELSTKEQL NKNSKLLKDK FVCQIQLERM NEGQVRGEKN RFKTADIIKE
 181 IIQLLNVQKN FHQLDENFIN KYIELVEMRR EYFEGPGKGS PYGWEGDPKA WYETLMGHCT
 241 YFPDELRSVK YAYSADLFNA LNDLNNLVIQ RDGLSKLEYH EKYHIIENVF KQKKKPTLKQ
 301 IANEINVNPE DIKGYRITKS GKPQFTEFKL YHDLKSVLFD QSILENEDVL DQIAEILTIY
 361 QDKDSIKSKL TELDILLNEE DKENIAQLTG YTGTHRLSLK CIRLVLEEQW YSSRNQMEIF
 421 THLNIKPKKI NLTAANKIPK AMIDEFILSP VVKRTFGQAI NLINKIIEKY GVPEDIIIEL
 481 ARENNSKDKQ KFINEMQKKN ENTRKRINEI IGKYGNQNAK RLVEKIRLHD EQEGKCLYSL
 541 ESIPLEDLLN NPNHYEVDHI IPRSVSFDNS YHNKVLVKQS ENSKKSNLTP YQYFNSGKSK
 601 LSYNQFKQHI LNLSKSQDRI SKKKKEYLLE ERDINKFEVQ KEFINRNLVD TRYATRELTN
 661 YLKAYFSANN MNVKVKTING SFTDYLRKVW KFKKERNHGY KHHAEDALII ANADFLFKEN
 721 KKLKAVNSVL EKPEIESKQL DIQVDSEDNY SEMFIIPKQV QDIKDFRNFK YSHRVDKKPN
 781 RQLINDTLYS TRKKDNSTYI VQTIKDIYAK DNTTLKKQFD KSPEKFLMYQ HDPRTFEKLE
 841 VIMKQYANEK NPLAKYHEET GEYLTKYSKK NNGPIVKSLK YIGNKLGSHL DVTHQFKSST
 901 KKLVKLSIKP YRFDVYLTDK GYKFITISYL DVLKKDNYYY IPEQKYDKLK LGKAIDKNAK
 961 FIASFYKNDL IKLDGEIYKI IGVNSDTRNM IELDLPDIRY KEYCELNNIK GEPRIKKTIG
1021 KKVNSIEKLT TDVLGNVFTN TQYTKPQLLF KRGN
```

FIG. 19H

*Staphylococcus pseudintermedius ED99* Cas9 (GenBank ADX75954.1, SEQ ID NO:118)

```
   1 MGRKPYILSL DIGTGSVGYA CMDKGFNVLK YHDKDALGVY LFDGALTAQE RRQFRTSRRR
  61 KNRRIKRLGL LQELLAPLVQ NPNFYQFQRQ FAWKNDNMDF KNKSLSEVLS FLGYESKKYP
 121 TIYHLQEALL LKDEKFDPEL IYMALYHLVK YRGHFLFDHL KIENLTNNDN MHDFVELIET
 181 YENLNNIKLN LDYEKTKVIY EILKDNEMTK NDRAKRVKNM EKKLEQFSIM LLGLKFNEGK
 241 LFNHADNAEE LKGANQSHTF ADNYEENLTP FLTVEQSEFI ERANKIYLSL TLQDILKGKK
 301 SMAMSKVAAY DKFRNELKQV KDIVYKADST RTQFKKIFVS SKKSLKQYDA TPNDQTFSSL
 361 CLFDQYLIRP KKQYSLLIKE LKKIIPQDSE LYFEAENDTL LKVLNTTDNA SIPMQINLYE
 421 AETILRNQQK YHAEITDEMI EKVLSLIQFR IPYYVGPLVN DHTASKFGWM ERKSNESIKP
 481 WNFDEVVDRS KSATQFIRRM TNKCSYLINE DVLPKNSLLY QEMEVLNELN ATQIRLQTDP
 541 KNRKYRMMPQ IKLFAVEHIF KKYKTVSHSK FLEIMLNSNH RENFMNHGEK LSIFGTQDDK
 601 KFASKLSSYQ DMTKIFGDIE GKRAQIEEII QWITIFEDKK ILVQKLKECY PELTSKQINQ
 661 LKKLNYSGWG RLSEKLLTHA YQGHSIIELL RHSDENFMEI LTNDVYGFQN FIKEENQVQS
 721 NKIQHQDIAN LTTSPALKKG IWSTIKLVRE LTSIFGEPEK IIMEFATEDQ QKGKKQKSRK
 781 QLWDDNIKKN KLKSVDEYKY IIDVANKLNN EQLQQEKLWL YLSQNGKCMY SGQSIDLDAL
 841 LSPNATKHYE VDHIFPRSFI KDDSIDNKVL VIKKMNQTKG DQVPLQFIQQ PYERIAYWKS
 901 LNKAGLISDS KLHKLMKPEF TAMDKEGFIQ RQLVETRQIS VHVRDFLKEE YPNTKVIPMK
 961 AKMVSEFRKK FDIPKIRQMN DAHHAIDAYL NGVVYHGAQL AYPNVDLFDF NFKWEKVREK
1021 WKALGEFNTK QKSRELFFFK KLEKMEVSQG ERLISKIKLD MNHFKINYSR KLANIPQQFY
1081 NQTAVSPKTA ELKYESNKSN EVVYKGLTPY QTYVVAIKSV NKKGKEKMEY QMIDHYVFDF
1141 YKFQNGNEKE LALYLAQREN KDEVLDAQIV YSLNKGDLLY INNHPCYFVS RKEVINAKQF
1201 ELTVEQQLSL YNVMNNKETN VEKLLIEYDF IAEKVINEYH HYLNSKLKEK RVRTFFSESN
1261 QTHEDFIKAL DELFKVVTAS ATRSDKIGSR KNSMTHRAFL GKGKDVKIAY TSISGLKTTK
1321 PKSLFKLAES RNEL
```

FIG. 19I

*Helicobacter mustelae* Cas9 (UniProtKB D3UFL8, SEQ ID NO:119)

```
   1 MIRTLGIDIG IASIGWAVIE GEYTDKGLEN KEIVASGVRV FTKAENPKNK ESLALPRTLA
  61 RSARRRNARK KGRIQQVKHY LSKALGLDLE CFVQGEKLAT LFQTSKDFLS PWELRERALY
 121 RVLDKEELAR VILHIAKRRG YDDITYGVED NDSGKIKKAI AENSKRIKEE QCKTIGEMMY
 181 KLYFQKSLNV RNKKESYNRC VGRSELREEL KTIFQIQQEL KSPWVNEELI YKLLGNPDAQ
 241 SKQEREGLIF YQRPLKGFGD KIGKCSHIKK GENSPYRACK HAPSAEEFVA LTKSINFLKN
 301 LTNRHGLCFS QEDMCVYLGK ILQEAQKNEK GLTYSKLKLL LDLPSDFEFL GLDYSGKNPE
 361 KAVFLSLPST FKLNKITQDR KTQDKIANIL GANKDWEAIL KELESLQLSK EQIQTIKDAK
 421 LNFSKHINLS LEALYHLLPL MREGKRYDEG VEILQERGIF SKPQPKNRQL LPPLSELAKE
 481 ESYFDIPNPV LRRALSEFRK VVNALLEKYG GFHYFHIELT RDVCKAKSAR MQLEKINKKN
 541 KSENDAASQL LEVLGLPNTY NNRLKCKLWK QQEEYCLYSG EKITIDHLKD QRALQIDHAF
 601 PLSRSLDDSQ SNKVLCLTSS NQEKSNKTPY EWLGSDEKKW DMYVGRVYSS NFSPSKKRKL
 661 TQKNFKERNE EDFLARNLVD TGYIGRVTKE YIKHSLSFLP LPDGKKEHIR IISGSMTSTM
 721 RSFWGVQEKN RDHHLHHAQD AIIIACIEPS MIQKYTTYLK DKETHRLKSH QKAQILREGD
 781 HKLSLRWPMS NFKDKIQESI QNIIPSHHVS HKVTGELHQE TVRTKEFYYQ AFGGEEGVKK
 841 ALKFGKIREI NQGIVDNGAM VRVDIFKSKD KGKFYAVPIY TYDFAIGKLP NKAIVQGKKN
 901 GIIKDWLEMD ENYEFCFSLF KNDCIKIQTK EMQEAVLAIY KSTNSAKATI ELEHLSKYAL
 961 KNEDEEKMFT DTDKEKNKTM TRESCGIQGL KVFQKVKLSV LGEVLEHKPR NRQNIALKTT
1021 PKHV
```

FIG. 19J

*Streptococcus pasteurianus* Cas9 (UniProtKB A0A135YMA6, SEQ ID NO:120)

```
   1 MTKKNYSIGL DIGTNSVGWA VITDDYKVPA KKMKVLGNTD KKYIKKNLLG ALLFDSGETA
  61 EATRLKRTAR RRYTRRKNRL RYLQEIFAEE MTKVDESFFY RLDESFLTTD EKDFERHPIF
 121 GNKADEIKYH QEFPTIYHLR KHLADSSEKA DLRLVYLALA HMIKFRGHFL IEGELNAENT
 181 DVQKIFADFV GVYDRTFDDS HLSEITVDAA SILTEKISKS RRLENLIKYY PTEKKNTLFG
 241 NLIALALGLQ PNFKMNFKLS EDAKLQFSKD SYNEDLEELL GKIGDDYADL FTSAKNLYDA
 301 ILLSGILTVD DNSTKAPLSA SMIKRYAEHH EDLEKLKEFI KANKSELYHD IFKDETKNGY
 361 AGYIENGVKQ DEFYKYLKNT LSKIAGSDYF LDKIEREDFL RKQRTFDNGS IPHQIHLQEM
 421 HAILRRQGDY YPFLKENQDR IEKILTFRIP YYVGPLARKD SRFSWAEYHS DEKITPWNFD
 481 KVIDKEKSAE KFITRMTLND LYLPEEKVLP KHSHVYETYA VYNELTKIKY VNEQGKDSFF
 541 DSNMKQEIFD HVFKENRKVT KEKLLNYLNK EFPEYRIKDL IGLDKENKSF NASLGTYHDL
 601 KKILDKAFLD DKVNEEVIED IIKTLTLFED KDMIHERLQK YSDIFTADQL KKLERRHYTG
 661 WGRLSYKLIN GIRNKENNKT ILDYLIDDGS ANRNFMQLIN DDTLPFKQII QKSQVVGDVD
 721 DIEAVVHDLP GSPAIKKGIL QSVKIVDELV KVMGDNPDNI VIEMARENQT TNRGRSQSQQ
 781 RLKKLQNSLK ELGSNILNEE KPSYIEDKVE NSHLQNDQLF LYYIQNGKDM YTGDELDIDH
 841 LSDYDIDHII PQAFIKDDSI DNRVLTSSAK NRGKSDDVPS LDIVRARKAE WVRLYKSGLI
 901 SKRKFDNLTK AERGGLTEAD KAGFIKRQLV ETRQITKHVA QILDARFNTE SDENDKVIRD
 961 VKVITLKSNL VSQFRKDFEF YKVREINDYH HAHDAYLNAV VGTALLKKYP KLASEFVYGE
1021 YKKYDVHKLI AKSSDDHSEM GKATAKYFFY SNLMNFFKRV IRYSNGKVIV RPVVEYSKDT
1081 EDIAWDKKSN FRTICKVLSY PQVNIVKKVE TQTGGFSKES ILPKGDSDKL IPRKTKKAYW
1141 DTKKYGGFDS PTVAYSVFVV ADVEKGKAKK LKTVKELVGI SIMERSFFEE NPVEFLENKG
1201 YHNIREDKLI KLPKYSLFEF EGGKRRLLAS ASELQKGNEM VIPGHLVKLL YHAQRINSFN
1261 STKYLDYVSA HKKEFEKVLS CVEDFANLYV DVEKNLSKIR AVADSMDNFS IEEISNSFIN
1321 LLTLTALGAP ADFNFLGEKI PRKRYTSTKE CLNATLIHQS ITGLYETRID LSKIGEE
```

FIG. 19K

*Streptococcus pasteurianus* (strain ATCC 43144 / JCM 5346 / CDC 1723-81) Cas9 (UniProtKB F5X275, SEQ ID NO:121)

```
   1 MTNGKILGLD IGIASVGVGI IEAKTGKVVH ANSRLFSAAN AENNAERRGF RGSRRLNRRK
  61 KHRVKRVRDL FEKYGIVTDF RNLNLNPYEL RVKGLTEQLK NEELFAALRT ISKRRGISYL
 121 DDAEDDSTGS TDYAKSIDEN RRLLKNKTPG QIQLERLEKY GQLRGNFTVY DENGEAHRLI
 181 NVFSTSDYEK EARKILETQA DYNKKITAEF IDDYVEILTQ KRKYYHGPGN EKSRTDYGRF
 241 RTDGTTLENI FGILIGKCNF YPDEYRASKA SYTAQEYNFL NDLNNLKVST ETGKLSTEQK
 301 ESLVEFAKNT ATLGPAKLLK EIAKILDCKV DEIKGYREDD KGKPDLHTFE PYRKLFNLE
 361 SINIDDLSRE VIDKLADILT LNTEREGIED AIKRNLPNQF TEEQISEIIK VRKSQSTAFN
 421 KGWHSFSAKL MNELIPELYA TSDEQMTILT RLEKFKVNKK SSKNTKTIDE KEVTDEIYNP
 481 VVAKSVRQTI KIINAAVKKY GDFDKIVIEM PRDKNADDEK KFIDKRNKEN KKEKDDALKR
 541 AAYLYNSSDK LPDEVFHGNK QLETKIRLWY QQGERCLYSG KPISIQELVH NSNNFEIDHI
 601 LPLSLSFDDS LANKVLVYAW TNQEKGQKTP YQVIDSMDAA WSFREMKDYV LKQKGLGKKK
 661 RDYLLTTENI DKIEVKKKFI ERNLVDTRYA SRVVLNSLQS ALRELGKDTK VSVVRGQFTS
 721 QLRRKWKIDK SRETYHHHAV DALIIAASSQ LKLWEKQDNP MFVDYGKNQV VDKQTGEILS
 781 VSDDEYKELV FQPPYQGFVN TISSKGFEDE ILFSYQVDSK YNRKVSDATI YSTRKAKIGK
 841 DKKEETYVLG KIKDIYSQNG FDTFIKKYNK DKTQFLMYQK DSLTWENVIE VILRDYPTTK
 901 KSEDGKNDVK CNPFEEYRRE NGLICKYSKK GKGTPIKSLK YYDKKLGNCI DITPEESRNK
 961 VILQSINPWR ADVYFNPETL KYELMGLKYS DLSFEKGTGN YHISQEKYDA IKEKEGIGKK
1021 SEFKFTLYRN DLILIKDIAS GEQEIYRFLS RTMPNVNHYV ELKPYDKEKF DNVQELVEAL
1081 GEADKVGRCI KGLNKPNISI YKVRTDVLGN KYFVKKKGDK PKLDFKNNKK
```

FIG. 19L

| Portion | Sequence (e.g., for use with Sau Cas9) | SEQ ID NO: |
|---|---|---|
| Y | GTTTTAGTACTCTGTAATTTTAGGTATGAGGTAGAC | 150 |
| | GUUUUAGUACUCUGUAAUUUUAGGUAUGAGGUAGAC | 151 |
| | GTTTTAGTACTCTG | 152 |
| | GUUUUAGUACUCUG | 153 |
| | GTTTTAGTACTCT | 154 |
| | GUUUUAGUACUCU | 155 |
| L | GGAAAC | 156 |
| | GGAAA | 157 |
| | GAAA | 158 |
| | TGAA | 159 |
| | UGAA | 160 |
| | AAA | 161 |
| Z | ATTGTACTTATACCTAAAATTACAGAATCTACTAAAACAAGGCAAAATGCCGTGTTTATCTCGTCAACTTGTTGGCGAGATTTTT | 162 |
| | AUUGUACUUAUACCUAAAAUUACAGAAUCUACUAAAACAAGGCAAAAUGCCGUGUUUAUCUCGUCAACUUGUUGGCGAGAUUUUU | 163 |
| | ACAGAATCTACTAAAACAAGGCAAAATGCCGTGTTTATCTCGTCAACTTGTTGGCGAGATTTTT | 164 |
| | ACAGAAUCUACUAAAACAAGGCAAAAUGCCGUGUUUAUCUCGUCAACUUGUUGGCGAGAUUUUU | 165 |
| | ACAGAATCTACTAAAACAAGGCAAAATGCCGTGTTTATCTCGTCAACTTGTTGGCGAGATTTTT | 166 |
| | ACAGAATCTACTAAAACAAGGCAAAATGCCGTGTTTATCTCGTCAACTTGTTGGCGAGATTTT | 167 |
| | ACAGAATCTACTAAAACAAGGCAAAATGCCGTGTTTATCTCGTCAACTTGTTGGCGAGATTT | 168 |
| | ACAGAATCTACTAAAACAAGGCAAAATGCCGTGTTTATCTCGTCAACTTGTTGGCGAGATT | 169 |
| | ACAGAATCTACTAAAACAAGGCAAAATGCCGTGTTTATCTCGTCAACTTGTTGGCGAGAT | 170 |
| | CAGAATCTACTAAAACAAGGCAAAATGCCGTGTTTATCTCGTCAACTTGTTGGCGAGATTTTT | 171 |
| | CAGAAUCUACUAAAACAAGGCAAAAUGCCGUGUUUAUCUCGUCAACUUGUUGGCGAGAUUUUU | 172 |
| | CAGAATCTACTAAAACAAGGCAAAATGCCGTGTTTATCTCGTCAACTTGTTGGCGAGATTTT | 173 |
| | CAGAATCTACTAAAACAAGGCAAAATGCCGTGTTTATCTCGTCAACTTGTTGGCGAGATTT | 174 |
| | CAGAATCTACTAAAACAAGGCAAAATGCCGTGTTTATCTCGTCAACTTGTTGGCGAGATT | 175 |
| | CAGAATCTACTAAAACAAGGCAAAATGCCGTGTTTATCTCGTCAACTTGTTGGCGAGAT | 176 |
| | CAGAATCTACTAAAACAAGGCAAAATGCCG | 177 |
| | CAGAATCTACTAAAACAAGGCAAAATGCC | 178 |

FIG. 20C

| Portion | Sequence (e.g., for use with Cje Cas9) | SEQ ID NO: |
|---|---|---|
| Y | GUUUUAGUCCCUUUUUAAAUUUCUUUAUGGUAAAU | 179 |
| | GTTTTAGTCCCTTTTTAAATTTCTTTATGGTAAAT | 180 |
| | GTTTTAGTCCCTT | 181 |
| | GUUUUAGUCCCUU | 182 |
| | GTTTTAGTCCCT | 183 |
| | GUUUUAGUCCCU | 184 |
| | GTTTTAGTCCC | 185 |
| | GUUUUAGUCCC | 186 |
| L | GAAA | 187 |
| | TGAA | 188 |
| | UGAA | 189 |
| | ATATTCAA | 190 |
| | TGTGGAAATATA | 191 |
| Z | AAGAAATTTAAAAAGGGACTAAAATAAAGAGTTTGCGGGACTCTGCGGGGTTACAATCCCCTAAAACCGCTTTT | 192 |
| | AAGAAAUUUAAAAAGGGACUAAAAUAAAGAGUUUGCGGGACUCUGCGGGGUUACAAUCCCCUAAAACCGCUUUU | 193 |
| | AGGGACTAAAATAAAGAGTTTGCGGGACTCTGCGGGGTTACAATCCCCTAAAACCGCTTTTTTT | 194 |
| | AGGGACUAAAAUAAAGAGUUUGCGGGACUCUGCGGGGUUACAAUCCCCUAAAACCGCUUUUUUU | 195 |
| | AGGGACTAAAATAAAGAGTTTGCGGGACTCTGCGGGGTTACAATCCCCTAAAACCGCTTTTTT | 196 |
| | AGGGACTAAAATAAAGAGTTTGCGGGACTCTGCGGGGTTACAATCCCCTAAAACCGCTTTTT | 197 |
| | AGGGACTAAAATAAAGAGTTTGCGGGACTCTGCGGGGTTACAATCCCCTAAAACCGCTTTT | 198 |
| | AGGGACTAAAATAAAGAGTTTGCGGGACTCTGCGGGGTTACAATCCCCTAAAACCGCTTT | 199 |
| | AGGGACTAAAATAAAGAGTTTGCGGGACTCTGCGGGGTTACAATCCCCTAAAACCGCTT | 200 |
| | AGGGACTAAAATAAAGAGTTTGCGGGACTCTGCGGGGTTACAATCCCCTAAAACCGCT | 201 |
| | AGGGACTAAAATAAAGAGTTTGCGGGACTCTGCGGGGTTACAATCCCCTAAAACCGC | 202 |
| | GGGACTAAAATAAAGAGTTTGCGGGACTCTGCGGGGTTACAATCCCCTAAAACCGCTTTTTTT | 203 |
| | GGGACUAAAAUAAAGAGUUUGCGGGACUCUGCGGGGUUACAAUCCCCUAAAACCGCUUUUUUU | 204 |
| | GGGACTAAAATAAAGAGTTTGCGGGACTCTGCGGGGTTACAATCCCCTAAAACCGCTTTTTT | 205 |
| | GGGACTAAAATAAAGAGTTTGCGGGACTCTGCGGGGTTACAATCCCCTAAAACCGCTTTTT | 206 |
| | GGGACTAAAATAAAGAGTTTGCGGGACTCTGCGGGGTTACAATCCCCTAAAACCGCTTTT | 207 |
| | GGGACTAAAATAAAGAGTTTGCGGGACTCTGCGGGGTTACAATCCCCTAAAACCGCTTT | 208 |
| | GGGACTAAAATAAAGAGTTTGCGGGACTCTGCGGGGTTACAATCCCCTAAAACCGCTT | 209 |
| | GGGACTAAAATAAAGAGTTTGCGGGACTCTGCGGGGTTACAATCCCCTAAAACCGCT | 210 |
| | GGGACTAAAATAAAGAGTTTGCGGGACTCTGCGGGGTTACAATCCCCTAAAACCGC | 211 |
| | GGGACTAAAATAAAGAGTTTGCGGGACTCT | 212 |

FIG. 20D

| Portion | Sequence (e.g., for use with Sth Cas9) | SEQ ID NO: |
|---|---|---|
| Y | GTTTTTGTACTCTCAAGATTTAAGTAACTGTACAAC | 213 |
| | GTTTTAGAGCTGTGTTGTTTCGAATGGTTCCAAAAC | 214 |
| | GGTTTGAAACCATTCGAAACAACACAGCGAGTTAAA | 215 |
| | CTTACACAGTTACTTAAATCTTGCAGAAGCTACAAA | 216 |
| | GTTTTTGTACTCTCAAGATTTAAGTAA | 217 |
| | GTTTTTGTACTCTCAAGA | 218 |
| | GTTTTTGTACTCTCAAG | 219 |
| | GTTTTAGAGCTGTGTTGTTTCGAATGG | 220 |
| | GTTTTAGAGCTGTGTTG | 221 |
| | GGTTTGAAACCATTCGA | 222 |
| | GGTTTGAAACCATTCG | 223 |
| | CTTACACAGTTACTTAA | 224 |
| | CTTACACAGTTACTT | 225 |
| L | GAAA | 226 |
| | TAAA | 227 |
| | ATTT | 228 |
| | GTTT | 229 |
| | TTT | 230 |
| | AAA | 231 |
| Z | TTACTTAAATCTTGCAGAAGCTACAAAGATAAGGCTTCATGCCGAAATCAACACCCTGTCATTTTATGGCAGGGTGTTTTCGTTATTTAA | 232 |
| | GTAAGGGGCGCCTTACACAGTTACTTAAATCTTGCAGAAGCTACAAAGATAAGGCTTCATGCCGAAATCAACACCCTGTCATTTTATGGCAGGGTGTTTTCGTT | 233 |
| | CTTACACAGTTACTTAAATCTTGCAGAAGCTACAAAGATAAGGCTTCATGCCGAAATCAACACCCTGTCATTTTATGGCAGGGTGTTTTCGTT | 234 |
| | CTTACACAGTTACTTAAATCTTGCAGAAGCTACAAA | 235 |
| | TTGTGGTTTGAAACCATTCGAAACAACACAGCGAGTTAAAATAAGGCTTAGTCCGTACTCAACTTGAAAAGGTGGCACCGATTCGGTGTTTTTTTT | 236 |
| | GGTTTGAAACCATTCGAAACAACACAGCGAGTTAAAATAAGGCTTAGTCCGTACTCAACTTGAAAAGGTGGCACCGATTCGGTGTTTTTTTT | 237 |
| | GGTTTGAAACCATTCGAAACAACACAGCGAGTTAAA | 238 |

FIG. 20E

| Portion | Sequence (e.g., for use with Wsu Cas9) | SEQ ID NO: |
|---|---|---|
| Y | GCAACACTTTATAGCAAATCCGCTTAGCCTGTGAAAC | 239 |
| | ATTATAGCGAGGAATGGCTGAGTAGGCGGCTATAAC | 240 |
| | GCAACACTTTATAGCAAATCCGCT | 241 |
| | GCAACACTTTATAGC | 242 |
| | GCAACACTTTA | 243 |
| Z | TTTCAAGGCATCGAACGGATTTGCTATAAAGTGTTGC | 244 |
| | TTTGTTAAAGCTGGATGGGATTATTATAGAGTGTTGC | 245 |
| | ATAGCCGCTGCCTACTCAGCCATTTAGCGCAGCGAC | 246 |
| | TATAGAGTGTTGC | 247 |
| | TAGAGUGTTGC | 248 |
| | TATAAAGTGTTGC | 249 |
| | TAAAGTGTTGC | 250 |

FIG. 20F

| Portion | Sequence (e.g., for use with Slu Cas9) | SEQ ID NO: |
|---|---|---|
| Y | GTTTTAGTACTCTGTAATTTTAGGTATAAGTGATAC | 251 |
| | TTTTAGTACTCTGTAATTTTAGGTATAAGTGATAC | 252 |
| | TCTGTAATTTTAGGTATAAGT | 253 |
| Z | CTTGTACTTATACCTAAAATTACAGAATCTACTGAA | 254 |
| | ACTTATACCTAAAATTACAGA | 255 |

FIG. 20G

| Portion | Sequence (e.g., for use with Sps Cas9) | SEQ ID NO: |
|---|---|---|
| Y | GTTTTAGCACTATGTTTATTTAGAAAGAGGTAAAAC | 256 |
| | ACTATGTTTATTTAGAAAGAGGTAAAAC | 257 |
| Z | GTTTTACTTCTTTCTAAATAAACATAGTTAAGTTAA | 258 |
| | GTTTTACTTCTTTCTAAATAAACATAGT | 259 |

FIG. 20H

| Portion | Sequence (e.g., for use with Hmu Cas9) | SEQ ID NO: |
|---|---|---|
| Y | ATTTTAGCATAAACATATTTATGAAGTGGCTAAAAC | 260 |
| Z | GTATTTGTCAATAAATATACTTTATAATGGCAAGAT | 261 |

FIG. 20I

| Portion | Sequence (e.g., for use with Spa Cas9) | SEQ ID NO: |
|---|---|---|
| Y | GTTTTTGTACTCTCAAGATTTAAGTAA | 262 |
| | GTTTTTGTACTCTCAAGA | 263 |
| | GTTTTTGTACTCTCAAG | 264 |
| L | TTAA | 265 |
| | TAAA | 266 |
| | TTT | 267 |
| | TTA | 268 |
| | AAA | 269 |
| Z | TTACTTAAATCTTGCTGAGCCTACAAAGATAAGGCTTTATGCCGAATTCAAGCACCCCATGTTTTGACATGAGGTGCTTTT | 270 |
| | TCTTGCTGAGCCTACAAAGATAAGGCTTTATGCCGAATTCAAGCACCCCATGTTTTGACATGAGGTGCTTTT | 271 |
| | CTTGCTGAGCCTACAAAGATAAGGCTTTATGCCGAATTCAAGCACCCCATGTTTTGACATGAGGTGCTTTT | 272 |
| | TCTTGCTGAGCCTACAAAGATAAGGCTTTATGCC | 273 |

FIG. 20J

| | Exemplary synthetic guiding components | SEQ ID NO: |
|---|---|---|
| Sau | W-X-GUUUAGUACUCUG-GAAA-CAGAAUCUACUAAAACAAGGCAAAAUGCCGUGUUAUCUCGUCAACUUGUUGGGAGAUUUU | 274 |
| | W-X-GTTTTAGTACTCTG-GAAA-CAGAATCTACTAAAACAAGGCAAAATGCCGTGTTTATCTCGTCAACTTGTTGGCGAGATTTT | 275 |
| | W-X-GUUUAGUACUCUG-GAAA-CAGAAUCUACUAAAACAAGGCAAAAUGCCGUGUUAUCUCGUCAACUUGUUGGGCGAGAUUU | 276 |
| | W-X-GTTTTAGTACTCTG-GAAA-CAGAATCTACTAAAACAAGGCAAAATGCCGTGTTTATCTCGTCAACTTGTTGGCGAGATT | 277 |
| Cje | W-X-GTTTTAGTCCCT-GAAA-AGGGACTAAAATAAAGAGTTTGCGGGACTCTGCGCGGGTTACAATCCCCTAAAACCGC | 278 |
| | W-X-GTTTTAGTCCCT-GAAAA-GGGACTAAAATAAAGAGTTTGCGGGACTCTGCGGGGTTACAATCCCCTAAAACCGC | 279 |
| | W-X-GUUUAGUCCCU-GAAAA-GGGACUAAAAUAAAGAGUUUGCGGGACUCUGCGGGUUACAAUCCCCUAAAACCGC | 280 |
| | W-X-GTTTTAGTCCCT-GAAA-AGGGACTAAAATAAAGAGTTTGCGGGACTCTGCGGGGTTACAATCCCCTAAAACCGCTTTTTT | 281 |
| | W-X-GTTTTAGTCCCT-GAAA-AGGGACTAAAATAAAGAGTTTGCGGGACTCTGCGGGGTTACAATCCCCTAAAACCGCTTTTTT | 282 |
| | W-X-GTTTTAGTCCC-TGAA-GGGACTAAAATAAAGAGTTTGCGGGACTCTGCGGGGTTACAATCCCCTAAAACCGCTTTTT | 283 |
| | W-X-GTTTTAGTCCT-TGTGGAAATATA-AGGGACTAAAATAAAGAGTTTGCGGGTTACAATCCCCTAAAACCGCTTTTTT | 284 |
| | W-X-GTTTTAGTCCT-ATATTCAA-AGGGACTAAAATAAAGAGTTTGCGGGACTCTGCGGGGTTACAATCCCCTAAAACCGCTTTTTT | 285 |
| Spa | W-X-GTTTTGTACTCTCAAGA-TTAA-TCTTGCTGAGCCTACAAAGATAAGGCTTTATGCCGAATTCAAGCACCCCATGTTTTGACATGAGGTGCTTTT | 286 |
| | W-X-GTTTTGTACTCTCAAGA-TTAA-TCTTGCTGAGCCTACAAAGATAAGGCTTTATGCCGAATTCAAGCACCCCATGTTTTGACATGAGGTGC | 287 |
| | W-X-GTTTTGTACTCTCAAGA-TAA-TCTTGCTGAGCCTACAAAGATAAGGCTTTATGCCGAATTCAAGCACCACCCATGTTTTGACATGAGGTGCTTTT | 288 |
| | W-X-GTTTTGTACTCTCAAGA-TAA-TCTTGCTGAGCCTACAAAGATAAGGCTTTATGCCGAATTCAAGCACCACCCATGTTTTGACATGAGGTGC | 289 |
| | W-X-GTTTTGTACTCTCAAG-AAA-CTTGCTGAGCCTACAAAGATAAGGCTTTATGCCGAATTCAAGCACCCCCATGTTTGACATGAGGTGCTTTT | 290 |
| | W-X-GTTTTGTACTCTCAAG-AAA-CTTGCTGAGCCTACAAAGATAAGGCTTTATGCCGAATTCAAGCACCCCCATGTTTGACATGAGGTGC | 291 |
| | W-X-GTTTTGTACTCTCAAG-AAT-CTTGCTGAGCCTACAAAGATAAGGCTTTATGCCGAATTCAAGCACCCCCATGTTTTGACATGAGGTGCTTTT | 292 |
| | W-X-GTTTTGTACTCTCAAG-AAT-CTTGCTGAGCCTACAAAGATAAGGCTTTATGCCGAATTCAAGCACCCCCATGTTTTGACATGAGGTGC | 293 |

CRISPR-CAS BASED SYSTEM FOR TARGETING SINGLE-STRANDED SEQUENCES

CROSS-REFERENCE TO RELATED APPLICATION

This application claims the benefit of U.S. Provisional Application No. 62/598,888, filed Dec. 14, 2017, which is hereby incorporated by reference in its entirety.

STATEMENT OF GOVERNMENT INTEREST

This invention was made with Government support under Contract No. DE-NA0003525 awarded by the United States Department of Energy/National Nuclear Security Administration and under Contract No. MCB-1244557 awarded by the National Science Foundation. The Government has certain rights in the invention.

REFERENCE TO A SEQUENCE LISTING APPENDIX

A sequence listing appendix including an ASCII formatted file accompanies this application. The appendix includes a file named "SD14537.1_ST25.txt," created on Dec. 13, 2018 (size of 3.63 megabytes), which is hereby incorporated by reference in its entirety.

FIELD OF THE INVENTION

The present invention relates to a CRISPR-Cas based system for targeting nucleic acid sequences. In part, the invention relates to synthetic guiding components for targeting single-stranded sequences and complexes including such components. Also described herein are methods of employing such components, e.g., to repress or activate a desired target within a subject.

BACKGROUND OF THE INVENTION

CRISPR-Cas based systems have emerged as a promising methodology for gene editing. Many studies focus on the use of a particular endonuclease, Cas9, and its function as a DNA endonuclease that cleaves DNA. Targeting and editing of RNA remains relatively unexplored. Accordingly, there is a need for synthetic constructs and methods that provide specific targeting and modulation of RNA targets.

SUMMARY OF THE INVENTION

The present invention relates, in part, to use of a CRISPR-Cas based system for programmable RNA binding and cleavage. In particular, we present evidence that *Staphylococcus aureus* (Sau) Cas9 is a dual DNA/RNA targeting nuclease, which can be employed in cells to regulate genes on both the transcriptional and translational level in parallel by accounting for target site PAM adjacency. In one non-limiting example, SauCas9 RNA-scission depends on a single-guide RNA (sgRNA) and does not need a PAMmer sequence, thereby simplifying outstanding issues in delivery. Due to its small size, SauCas9 can be efficiently delivered to cells by use of a vector including a nucleic acid sequence encoding SauCas9 (e.g., an adeno-associated virus (AAV) vector). Further, Cas9-sgRNA could be delivered as a ribonucleoprotein complex, further providing additional in vitro and in vivo delivery options. Finally, the RNA-targeting capability of SauCas9 offers the advantage of modulating targets that rely primarily on RNA molecules (e.g., repressing viruses whose lifecycles consist of solely RNA molecules, thereby inaccessible to DNA cleavage) and of providing orthogonal, non-DNA targets for gene modification (e.g., regulating site-specific epigenetic modifications of RNA or providing isoform-specific targeting of RNA transcripts).

Accordingly, in a first non-limiting aspect, the present invention features a synthetic guiding component including a structure having the formula (I): W—X—Y-L-Z or salt thereof (e.g., 5'-W—X—Y-L-Z-3'). In one embodiment, W is an optional third portion including a nucleic acid sequence of from about 1 to 20 nucleic acids; X is a targeting portion including a nucleic acid sequence configured to bind to a target site of a single-stranded target sequence; Y is a first portion including a nucleic acid sequence configured to interact with a nuclease configured to bind and/or cleave the single-stranded target sequence; L is a linker; and Z is a second portion including a nucleic acid sequence configured to interact with the nuclease and the first portion.

In some embodiments, Y includes a nucleic acid sequence having at least 80% sequence identity (e.g., 85%, 90%, 95%, 96%, 97%, 98%, 99%, or 100% sequence identity) to any one of SEQ ID NOs:150-155, 179-186, 213-225, 239-243, 251-253, 256, 257, 260, and 262-264, or a complement of any of these, or a fragment thereof (e.g., a fragment having of from about 10 to about 50 nucleotides, such as of from about 10 to 15, 10 to 20, 10 to 25, 10 to 30, 10 to 35, 10 to 40, 10 to 45, 12 to 15, 12 to 20, 12 to 25, 12 to 30, 12 to 35, 12 to 40, 12 to 45, 12 to 50, 15 to 20, 15 to 25, 15 to 30, 15 to 35, 15 to 40, 15 to 45, 15 to 50, 20 to 25, 20 to 30, 20 to 35, 20 to 40, 20 to 45, 20 to 50, 25 to 30, 25 to 35, 25 to 40, 25 to 45, or 25 to 50 nucleotides).

In some embodiments, Z includes a nucleic acid sequence having at least 80% sequence identity (e.g., 85%, 90%, 95%, 96%, 97%, 98%, 99%, or 100% sequence identity) to any one of SEQ ID NOs:162-178, 192-212, 232-238, 244-250, 254, 255, 258, 259, 261, and 270-273, or a complement of any of these, or a fragment thereof (e.g., a fragment having of from about 10 to about 100 nucleotides, such as of from about 10 to 30, 10 to 40, 10 to 50, 10 to 60, 10 to 70, 10 to 80, 10 to 90, 20 to 30, 20 to 40, 20 to 50, 20 to 60, 20 to 70, 20 to 80, 20 to 90, 20 to 100, 30 to 40, 30 to 50, 30 to 60, 30 to 70, 30 to 80, 30 to 90, 30 to 100, 40 to 50, 40 to 60, 40 to 70, 40 to 80, 40 to 90, 40 to 100, 50 to 60, 50 to 70, 50 to 80, 50 to 90, 50 to 100, 60 to 80, 60 to 90, 60 to 100, 70 to 80, 70 to 90, 70 to 100, 80 to 90, 80 to 100, or 90 to 100 nucleotides).

In some embodiments, L includes a bond or a nucleic acid sequence having at least 80% sequence identity (e.g., 85%, 90%, 95%, 96%, 97%, 98%, 99%, or 100% sequence identity) to any one of SEQ ID NOs:156-161, 187-191, 226-231, and 265-269, or a complement of any of these, or a fragment thereof (e.g., a fragment having of from about 1 to about 10 nucleotides, such as from about 1 to 4, 1 to 5, 1 to 6, 1 to 7, 1 to 8, 1 to 9, 2 to 4, 2 to 5, 2 to 6, 2 to 7, 2 to 8, 2 to 9, or 2 to 10 nucleotides).

In some embodiments, the synthetic guiding component includes a nucleic acid sequence having at least 80% sequence identity (e.g., 85%, 90%, 95%, 96%, 97%, 98%, 99%, or 100% sequence identity) to any one of SEQ ID NOs:274-293, or a complement of any of these, or a fragment thereof (e.g., a fragment having of from about 75 to 250 nucleotides, such as of from about 75 to 100, 75 to 150, 75 to 200, 80 to 100, 80 to 150, 80 to 200, 80 to 250, 90 to 100, 90 to 150, 90 to 200, 90 to 250, 100 to 150, 100 to 200, 100 to 250, 150 to 200, 150 to 250, or 200 to 250 nucleotides, in which the length can either include or exclude W and/or X).

In some embodiments, W and/or Y includes one or more modified nucleic acids (e.g., a modified nucleic acid configured to promote access of the Cas enzyme to the target site, such as a sugar modification and/or a backbone modification) or bulges (e.g., inclusion of one or more unpaired nucleotides upon binding of W to a portion of the target sequence or upon binding of Y to the target sequence).

In some embodiments, X is configured to bind to the target site of a single-stranded human RNA target sequence (e.g., a mRNA target sequence) or a single-stranded pathogen target sequence (e.g., a viral RNA sequence).

In some embodiments, X has a length of from about 10 to about 30 nucleotides (e.g., of from about 10 to 15, 10 to 16, 10 to 17, 10 to 18, 10 to 19, 10 to 20, 10 to 21, 10 to 22, 10 to 23, 10 to 24, 10 to 25, 10 to 26, 10 to 27, 10 to 28, 10 to 29, 11 to 15, 11 to 16, 11 to 17, 11 to 18, 11 to 19, 11 to 20, 11 to 21, 11 to 22, 11 to 23, 11 to 24, 11 to 25, 11 to 26, 11 to 27, 11 to 28, 11 to 29, 11 to 30, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 27, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 nucleotides).

In some embodiments, Y includes a nucleic acid sequence having at least 80% sequence identity to any one of SEQ ID NOs:150-155, or a complement of any of these, or a fragment thereof; L is a bond or includes a nucleic acid sequence having at least 80% sequence identity to any one of SEQ ID NOs:156-161, or a complement of any of these, or a fragment thereof; and/or Z includes a nucleic acid sequence having at least 80% sequence identity to any one of SEQ ID NOs:162-178, or a complement of any of these, or a fragment thereof. In further embodiments, the nuclease includes an amino acid sequence having at least 80% sequence identity to any one of wild-type *Staphylococcus aureus* Cas9 (e.g., SauCas, e.g., SEQ ID NO:100 or 110), dSauCas9 (e.g., D10A and N580A, SEQ ID NO:101), or a fragment thereof.

In some embodiments, Y includes a nucleic acid sequence having at least 80% sequence identity to any one of SEQ ID NOs:179-186, or a complement of any of these, or a fragment thereof; L is a bond or includes a nucleic acid sequence having at least 80% sequence identity to any one of SEQ ID NOs:187-191, or a complement of any of these, or a fragment thereof; and Z includes a nucleic acid sequence having at least 80% sequence identity to any one of SEQ ID NOs:192-212, or a complement of any of these, or a fragment thereof. In further embodiments, the nuclease includes an amino acid sequence having at least 80% sequence identity to any one of *Campylobacter jejuni* Cas9 (CjeCas9, e.g., SEQ ID NO:104), *Campylobacter jejuni* subsp. *jejuni* serotype 0:2 Cas9 (e.g., SEQ ID NO:111), or a fragment thereof.

In some embodiments, Y includes a nucleic acid sequence having at least 80% sequence identity to any one of SEQ ID NOs: 213-225, or a complement of any of these, or a fragment thereof; L is a bond or includes a nucleic acid sequence having at least 80% sequence identity to any one of SEQ ID NOs:226-231, or a complement of any of these, or a fragment thereof; and Z includes a nucleic acid sequence having at least 80% sequence identity to any one of SEQ ID NOs:232-238, or a complement of any of these, or a fragment thereof. In further embodiments, the nuclease includes an amino acid sequence having at least 80% sequence identity to any one of *Streptococcus thermophilus* Cas9 (e.g., SEQ ID NO:112), *Streptococcus thermophilus* (strain ATCC BAA-491/MD-9) Cas9-1 (e.g., SEQ ID NO:113), *Streptococcus thermophilus* (strain ATCC BAA-491/MD-9) Cas9-2 (e.g., SEQ ID NO:114), or a fragment thereof.

In some embodiments, Y includes a nucleic acid sequence having at least 80% sequence identity to any one of SEQ ID NOs:239-243, or a complement of any of these, or a fragment thereof; and Z includes a nucleic acid sequence having at least 80% sequence identity to any one of SEQ ID NOs:244-250, or a complement of any of these, or a fragment thereof. In further embodiments, the nuclease includes an amino acid sequence having at least 80% sequence identity to any one of *Wolinella succinogenes* Cas9 (e.g., SEQ ID NO:115), *Wolinella succinogenes* Cas9/Csx12 (e.g., SEQ ID NO:116), or a fragment thereof.

In some embodiments, Y includes a nucleic acid sequence having at least 80% sequence identity to any one of SEQ ID NOs:251-253, or a complement of any of these, or a fragment thereof; and Z includes a nucleic acid sequence having at least 80% sequence identity to any one of SEQ ID NOs:254-255, or a complement of any of these, or a fragment thereof. In further embodiments, the nuclease includes an amino acid sequence having at least 80% sequence identity to *Staphylococcus lugdunensis* Cas9 (e.g., SEQ ID NO:117) or a fragment thereof. In some embodiments, Y includes a nucleic acid sequence having at least 80% sequence identity to any one of SEQ ID NOs:256-257, or a complement of any of these, or a fragment thereof; and Z includes a nucleic acid sequence having at least 80% sequence identity to any one of SEQ ID NOs:258-259, or a complement of any of these, or a fragment thereof. In further embodiments, the nuclease includes an amino acid sequence having at least 80% sequence identity to *Staphylococcus* pseudintermedius Cas9 (e.g., *Staphylococcus* pseudintermedius ED99 Cas9 or SEQ ID NO:118) or a fragment thereof.

In some embodiments, Y includes a nucleic acid sequence having at least 80% sequence identity to SEQ ID NO:260, or a complement of any of these, or a fragment thereof; and Z includes a nucleic acid sequence having at least 80% sequence identity to SEQ ID NO:261, or a complement of any of these, or a fragment thereof. In further embodiments, the nuclease includes an amino acid sequence having at least 80% sequence identity to *Helicobacter mustelae* Cas9 (e.g., SEQ ID NO:119) or a fragment thereof.

In some embodiments, Y includes a nucleic acid sequence having at least 80% sequence identity to any one of SEQ ID NOs:262-264, or a complement of any of these, or a fragment thereof; L is a bond or includes a nucleic acid sequence having at least 80% sequence identity to any one of SEQ ID NOs:265-269, or a complement of any of these, or a fragment thereof; and Z includes a nucleic acid sequence having at least 80% sequence identity to any one of SEQ ID NOs:270-273, or a complement of any of these, or a fragment thereof. In further embodiments, the nuclease includes an amino acid sequence having at least 80% sequence identity to any one of *Streptococcus pasteurianus* Cas9 (e.g., SEQ ID NO:120), *Streptococcus pasteurianus* (strain ATCC 43144/JCM 5346/CDC 1723-81) Cas9 (e.g., SEQ ID NO:121, or a fragment thereof.

In a second non-limiting aspect, the invention features a nucleoprotein complex including: a synthetic guiding component (e.g., any described herein); and a nuclease configured to bind and/or cleave a single-stranded target sequence.

In some embodiments, the nuclease is a Cas protein or a modified form thereof. In other embodiments, the nuclease includes an amino acid sequence having at least 80% sequence identity (e.g., 85%, 90%, 95%, 96%, 97%, 98%, 99%, or 100% sequence identity) to any one of SEQ ID NOs:100, 101, 104, and 110-121, or a fragment thereof (e.g., as described herein).

In other embodiments, the complex further includes one or more inorganic ions (e.g., monovalent and/or divalent ions) associated with the complex (e.g., any useful ion or combinations thereof, such as potassium (e.g., $K^+$), magnesium (e.g., $Mg^{2+}$), lithium (e.g., $Li^+$), sodium (e.g., $Na^+$), calcium (e.g., $Ca^{2+}$), manganese (e.g., $Mn^{2+}$), cadmium (e.g., $Cd^{2+}$), lead (e.g., PV), europium (e.g., $Eu^{3+}$), and thallium (e.g., $Tl^+$) ions, as well as combinations thereof).

In a third aspect, the invention features a method of modulating a single-stranded target sequence (e.g., an exogenous single-stranded target sequence) in a subject (e.g., any described herein). In some embodiments, the method includes: identifying an enriched single-stranded target sequence that is enriched in the subject when exposed to an exogenous pathogen (e.g., a virus, a bacterium, or any other described herein), as compared to the subject that is not exposed to the exogenous pathogen; designing a targeting portion of a synthetic guiding component (e.g., where the targeting portion is configured to bind to the enriched single-stranded target sequence, and/or where the synthetic guiding component is any described herein); and administering an effective amount of the synthetic guiding component, or a nucleic acid sequence encoding the synthetic guiding component, to the subject.

In some embodiments, the enriched single-stranded target sequence includes a portion of a genome for a pathogen (e.g., a virus), and the targeting portion of the synthetic guiding component is sufficiently complementary to the portion of the genome. In other embodiments, the enriched single-stranded target sequence has low structural complexity (e.g., characterized by a lack of secondary structure, such as a lack of base pairing, a lack of junctions, or a lack of stacking regions; or characterized by regions of accessible nucleic acids, such as loop regions or bulge regions having unpaired bases).

In a third non-limiting aspect, the invention features a method of modulating a target within a subject, the method including: identifying a single-stranded target sequence within the subject; designing a targeting portion of a synthetic guiding component (e.g., where the targeting portion is configured to bind to the single-stranded target sequence, and/or where the synthetic guiding component includes any structure described herein); and administering an effective amount of the synthetic guiding component, or a nucleic acid sequence encoding the synthetic guiding component, to the subject.

In a fourth non-limiting aspect, the invention features a method of modulating a target within a pathogen (e.g., a genome of the pathogen). In some embodiments, the method includes: identifying a single-stranded target sequence within the pathogen; designing a targeting portion of a synthetic guiding component (e.g., where the targeting portion is configured to bind to the single-stranded target sequence, and/or where the synthetic guiding component includes any structure described herein); and administering an effective amount of the synthetic guiding component, or a nucleic acid sequence encoding the synthetic guiding component, to the pathogen.

In any embodiment herein, the method includes identifying a single-stranded target sequence. In some embodiments, the identifying step includes determining a secondary structure of the single-stranded target sequence and choosing a target site in proximity to the secondary structure characterized by low structural complexity (e.g., characterized by a lack of secondary structure, such as a lack of base pairing interactions, a lack of junctions, or a lack of stacking regions; or characterized by regions of accessible nucleic acids, such as loop regions or bulge regions having unpaired bases).

In any embodiment herein, the method includes administering an effective amount of a nuclease, or a nucleic acid sequence encoding the nuclease. In particular embodiments, the nuclease is configured to interact with the synthetic guiding component and to bind and/or cleave the enriched single-stranded target sequence.

In any embodiment herein, the method includes modulating a target (e.g., increasing or decreasing the amount of a target, as compared to a control in which the synthetic guiding construct is not provided to the subject). Such modulating can include modulating RNA processing (e.g., modulating the activity of RNA polymerase), modulating viral replication (e.g., cleaving viral RNA), modulating gene expression by cleaving mRNA, interfering with protein binding to RNA, modulating splicing or RNA, modulating RNA transport, modulating localization of RNA, modulating translation of RNA, modulating turnover of mRNA, and modulating RNA folding.

In any embodiment herein, the single-stranded target sequence is a single-stranded RNA (e.g., a coding RNA or a non-coding RNA, such as any described herein).

In any embodiment herein, the effective amount of the synthetic guiding component is an amount sufficient to reduce expression of the target (e.g., in which the target is a gene product, such as a protein). In particular embodiments, the synthetic guiding component is configured to bind to the single-stranded target sequence that directly regulates the expression of the target (e.g., by cleaving the mRNA that encodes the target). In other embodiments, the synthetic guiding component is configured to bind to the single-stranded target sequence that indirectly regulates the expression of the target (e.g., by interfering with protein binding to RNA, which in turn interferes with expression of the target).

In any embodiment herein, the effective amount of the synthetic guiding component is an amount sufficient to increase expression of the target (e.g., in which the target is a gene product, such as a protein).

In any embodiment herein, the single-stranded target sequence is a single-stranded ribonucleic acid sequence (e.g., a portion of a sequence that is single-stranded or an entire sequence that is single-stranded). Exemplary single-stranded RNA sequences can include coding RNA or non-coding RNA, e.g., messenger RNA (mRNA, including elements thereof, such as a riboswitch, an untranslated region, a coding sequence, a start codon, a 5' cap, or a poly-adenine tail), transfer-messenger RNA (tmRNA), ribosomal RNA (rRNA, such as the 30S, 40S, 50S, 60S, 80S, 5S, 5.8S, 12S, 16S, 18S, 23S, and 28S subunits), ribozyme, transfer RNA (tRNA), heterogeneous nuclear RNA (hnRNA), circular RNA, signal recognition particle RNA (SRP RNA, such as 4.5S, 6S, 7SL, or ffs RNA), X-inactive specific transcript (Xist), microRNA (miRNA), small interfering RNA (siRNA), piwi-interacting RNA (piRNA), small nucleolar RNA (snoRNA, such as small Cajal body-specific RNA (scaRNA)), small nuclear RNA (snRNA), extracellular RNA (exRNA), long non-coding RNA (lncRNA), large intergenic non-coding RNA (lincRNA), intergenic RNA, enhancer RNA (eRNA), satellite RNA (satRNA), and promoter-associated RNA (PAR).

In any embodiment herein, the nuclease is a Cas protein or a modified form thereof. In some embodiments, the nuclease includes an amino acid sequence having at least 80% sequence identity (e.g., 85%, 90%, 95%, 96%, 97%, 98%, 99%, or 100% sequence identity) to any one of SEQ ID NOs:100, 101, 104, and 110-121, or a fragment thereof (e.g., a fragment having of from about 500 to 1800 amino acids, such as of from about 500 to 1700, 500 to 1600, 500 to 1500, 500 to 1400, 500 to 1300, 500 to 1200, 500 to 1100, 500 to 1000, 500 to 950, 500 to 900, 600 to 1800, 600 to 1700, 600 to 1600, 600 to 1500, 600 to 1400, 600 to 1300, 600 to 1200, 600 to 1100, 600 to 1000, 600 to 950, 600 to 900, 700 to 1800, 700 to 1700, 700 to 1600, 700 to 1500, 700 to 1400, 700 to 1300, 700 to 1200, 700 to 1100, 700 to 1000, 700 to 950, 700 to 900, 800 to 1800, 800 to 1700, 800 to 1600, 800 to 1500, 800 to 1400, 800 to 1300, 800 to 1200, 800 to 1100, 800 to 1000, 800 to 950, 800 to 900, 900 to 1800, 900 to 1700, 900 to 1600, 900 to 1500, 900 to 1400, 900 to 1300, 900 to 1200, 900 to 1100, 900 to 1000, 900 to 950, 1000 to 1800, 1000 to 1700, 1000 to 1600, 1000 to 1500, 1000 to 1400, 1000 to 1300, 1000 to 1200, 1000 to 1100, 1100 to 1800, 1100 to 1700, 1100 to 1600, 1100 to 1500, 1100 to 1400, 1100 to 1300, 1100 to 1200, 1200 to 1800, 1200 to 1700, 1200 to 1600, 1200 to 1500, 1200 to 1400, 1200 to 1300, 1300 to 1800, 1300 to 1700, 1300 to 1600, 1300 to 1500, 1300 to 1400, 1400 to 1800, 1400 to 1700, 1400 to 1600, 1400 to 1500, 1500 to 1800, 1500 to 1700, 1500 to 1600, 1600 to 1800, 1600 to 1700, or 1700 to 1800 amino acids).

In any embodiment herein, the nuclease can be a fusion protein including a Cas9 domain and another domain (e.g., a polymerase (e.g., a RNA-dependent RNA polymerase), a riboswitch, a ribozyme, a transcriptional activator, a repressive transcriptional domain, or an epigenetic effector domain.

In any embodiment herein, the synthetic guiding component include a structure having the formula (I): W—X—Y-L-Z or salt thereof. In some embodiments, W has a length of from 0 to about 20 nucleotides (e.g., of from about 0 to 4, 0 to 5, 0 to 6, 0 to 7, 0 to 8, 0 to 9, 0 to 10, 0 to 15, 1 to 4, 1 to 5, 1 to 6, 1 to 7, 1 to 8, 1 to 9, 1 to 10, 1 to 15, 1 to 20, 2 to 4, 2 to 5, 2 to 6, 2 to 7, 2 to 8, 2 to 9, 2 to 10, 2 to 15, 2 to 20, 3 to 4, 3 to 5, 3 to 6, 3 to 7, 3 to 8, 3 to 9, 3 to 10, 3 to 15, 3 to 20, 4 to 4, 4 to 5, 4 to 6, 4 to 7, 4 to 8, 4 to 9, 4 to 10, 4 to 15, 4 to 20, 5 to 6, 5 to 7, 5 to 8, 5 to 9, 5 to 10, 5 to 15, 5 to 20, 10 to 15, 10 to 20, or 15 to 20 nucleotides, and optionally including one or more modified nucleotides, such as any described herein); X has a length of from about 10 to about 35 nucleotides (e.g., of from about 10 to 11, 10 to 12, 10 to 13, 10 to 14, 10 to 15, 10 to 17, 10 to 20, 10 to 25, 10 to 30, 12 to 13, 12 to 14, 12 to 15, 12 to 17, 12 to 20, 12 to 25, 12 to 30, 13 to 14, 13 to 15, 13 to 17, 13 to 20, 13 to 25, 13 to 30, 13 to 35, 14 to 15, 14 to 17, 14 to 20, 14 to 25, 14 to 30, 14 to 35, 15 to 17, 15 to 20, 15 to 25, 15 to 30, 15 to 25, 17 to 20, 17 to 25, 17 to 30, 17 to 35, 18 to 20, 18 to 25, 18 to 30, 18 to 35, 19 to 20, 19 to 25, 19 to 30, 19 to 35, 20 to 21, 20 to 22, 20 to 23, 20 to 24, 20 to 25, 20 to 26, 20 to 27, 20 to 28, 20 to 29, 20 to 30, 20 to 31, 20 to 32, 20 to 33, 20 to 34, 20 to 35, 21 to 22, 21 to 23, 21 to 24, 21 to 25, 21 to 26, 21 to 27, 21 to 28, 21 to 29, 21 to 30, 21 to 31, 21 to 32, 21 to 33, 21 to 34, 21 to 35, 22 to 23, 22 to 24, 22 to 25, 22 to 26, 22 to 27, 22 to 28, 22 to 29, 22 to 30, 22 to 31, 22 to 32, 22 to 33, 22 to 34, 22 to 35, 23 to 24, 23 to 25, 23 to 26, 23 to 27, 23 to 28, 23 to 29, 23 to 30, 23 to 31, 23 to 32, 23 to 33, 23 to 34, 23 to 35, 24 to 25, 24 to 26, 24 to 27, 24 to 28, 24 to 29, 24 to 30, 24 to 31, 24 to 32, 24 to 33, 24 to 34, 24 to 35, 25 to 26, 25 to 27, 25 to 28, 25 to 29, 25 to 30, 25 to 31, 25 to 32, 25 to 33, 25 to 34, 25 to 35, 26 to 27, 26 to 28, 26 to 29, 26 to 30, 26 to 31, 26 to 32, 26 to 33, 26 to 34, 26 to 35, 27 to 28, 27 to 29, 27 to 30, 27 to 31, 27 to 32, 27 to 33, 27 to 34, 27 to 35, 28 to 29, 28 to 30, 28 to 31, 28 to 32, 28 to 33, 28 to 34, 28 to 35, 29 to 30, 29 to 31, 29 to 32, 29 to 33, 29 to 34, 29 to 35, 30 to 31, 30 to 32, 30 to 33, 30 to 34, 30 to 35, 31 to 32, 31 to 33, 31 to 34, 31 to 35, 32 to 33, 32 to 34, 32 to 35, 33 to 34, 33 to 35, or 34 to 35 nucleotides, and optionally including one or more base pair mismatches upon binding to the target site); Y has a length of from about 10 to about 50 nucleotides (e.g., of from about 10 to 20, 10 to 25, 10 to 30, 10 to 35, 10 to 40, 10 to 45, 15 to 20, 15 to 25, 15 to 30, 15 to 35, 15 to 40, 15 to 45, 15 to 50, 20 to 25, 20 to 30, 20 to 35, 20 to 40, 20 to 45, 20 to 50, 25 to 30, 25 to 35, 25 to 40, 25 to 45, 25 to 50, 30 to 35, 30 to 40, 30 to 45, 30 to 50, 35 to 40, 35 to 45, 35 to 50, 40 to 45, 40 to 50, or 45 to 50 nucleotides, and optionally including one or more modified nucleotides, such as any described herein); L has a length of from 0 to about 15 nucleotides (e.g., L is a bond, an $C_{1-10}$ alkylene, a $C_{1-10}$ heteroalkylene, or has a length of from about 0 to 10 nucleotides, such as 0 to 2, 0 to 4, 0 to 6, 0 to 8, 0 to 10, 0 to 15, 2 to 4, 2 to 6, 2 to 8, 2 to 10, 2 to 15, 4 to 6, 4 to 8, 4 to 10, 4 to 15, 6 to 8, 6 to 10, 6 to 15, 8 to 10, 8 to 15, 10 to 15, or 13 to 15 nucleotides); and/or Z has a length of from about 10 to about 100 nucleotides (e.g., of from about 10 to 20, 10 to 30, 10 to 40, 10 to 50, 10 to 60, 10 to 70, 10 to 80, 10 to 90, 20 to 30, 20 to 40, 20 to 50, 20 to 60, 20 to 70, 20 to 80, 20 to 90, 20 to 100, 30 to 40, 30 to 50, 30 to 60, 30 to 70, 30 to 80, 30 to 90, 30 to 100, 40 to 50, 40 to 60, 40 to 70, 40 to 80, 40 to 90, 40 to 100, 50 to 60, 50 to 70, 50 to 80, 50 to 90, 50 to 100, 60 to 70, 60 to 80, 60 to 90, 60 to 100, 70 to 80, 70 to 90, 70 to 100, 80 to 90, 80 to 100, or 90 to 100 nucleotides).

In any embodiment herein, the synthetic guiding construct has a length of from about 80 to about 300 nucleotides (e.g., of from about 80 to 90, 80 to 100, 80 to 125, 80 to 150, 80 to 175, 80 to 200, 80 to 225, 80 to 250, 80 to 275, 90 to 100, 90 to 125, 90 to 150, 90 to 175, 90 to 200, 90 to 225, 90 to 250, 90 to 275, 90 to 300, 100 to 125, 100 to 150, 100 to 175, 100 to 200, 100 to 225, 100 to 250, 100 to 275, 100 to 300, 125 to 150, 125 to 175, 125 to 200, 125 to 225, 125 to 250, 125 to 275, 125 to 300, 150 to 175, 150 to 200, 150 to 225, 150 to 250, 150 to 275, 150 to 300, 175 to 200, 175 to 225, 175 to 250, 175 to 275, 175 to 300, 200 to 225, 200 to 250, 200 to 275, 200 to 300, 250 to 275, 250 to 300, or 275 to 300 nucleotides).

In any embodiment herein, the synthetic guiding construct does not include a protospacer-adjacent motif sequence.

In any embodiment herein, the synthetic guiding construct and/or the nuclease can be provided as a vector (e.g., as a vector including a sequence that encodes the synthetic guiding construct and/or the nuclease).

Definitions

As used herein, the term "about" means+/−10% of any recited value. As used herein, this term modifies any recited value, range of values, or endpoints of one or more ranges.

The term "effective" is used herein, unless otherwise indicated, to describe an amount of a compound, composition or component which, when used within the context of its use, produces or effects an intended result, whether that result relates to the prophylaxis and/or therapy of an infection and/or disease state or as otherwise described herein. The term effective subsumes all other effective amount or effective concentration terms (including the term "therapeutically effective") which are otherwise described or used in the present application.

The term "compound" or "construct" is used herein to describe any specific compound or bioactive agent disclosed herein, including any and all stereoisomers (including diastereomers), individual optical isomers (enantiomers) or racemic mixtures, pharmaceutically acceptable salts (including alternative pharmaceutically acceptable salts when a pharmaceutically acceptable salt is disclosed) and prodrug forms. The term compound herein refers to stable compounds. Within its use in context, the term compound may refer to a single compound or a mixture of compounds as otherwise described herein.

By "salt" is meant an ionic form of a compound or structure (e.g., any formulas, compounds, constructs, or compositions described herein), which includes a cation or anion compound to form an electrically neutral compound or structure. Salts are well known in the art. For example, non-toxic salts are described in Berge S M et al., "Pharmaceutical salts," *J. Pharm. Sci.* 1977 January; 66(1):1-19; and in "Handbook of Pharmaceutical Salts: Properties, Selection, and Use," Wiley-VCH, April 2011 (2nd rev. ed., eds. P. H. Stahl and C. G. Wermuth. The salts can be prepared in situ during the final isolation and purification of the compounds of the invention or separately by reacting the free base group with a suitable organic acid (thereby producing an anionic salt) or by reacting the acid group with a suitable metal or organic salt (thereby producing a cationic salt). Representative anionic salts include acetate, adipate, alginate, ascorbate, aspartate, benzenesulfonate, benzoate, bicarbonate, bisulfate, bitartrate, borate, bromide, butyrate, camphorate, camphorsulfonate, chloride, citrate, cyclopentanepropionate, digluconate, dihydrochloride, diphosphate, dodecylsulfate, edetate, ethanesulfonate, fumarate, glucoheptonate, glucomate, glutamate, glycerophosphate, hemisulfate, heptonate, hexanoate, hydrobromide, hydrochloride, hydroiodide, hydroxyethanesulfonate, hydroxynaphthoate, iodide, lactate, lactobionate, laurate, lauryl sulfate, malate, maleate, malonate, mandelate, mesylate, methanesulfonate, methylbromide, methylnitrate, methylsulfate, mucate, 2-naphthalenesulfonate, nicotinate, nitrate, oleate, oxalate, palmitate, pamoate, pectinate, persulfate, 3-phenylpropionate, phosphate, picrate, pivalate, polygalacturonate, propionate, salicylate, stearate, subacetate, succinate, sulfate, tannate, tartrate, theophyllinate, thiocyanate, triethiodide, toluenesulfonate, undecanoate, valerate salts, and the like. Representative cationic salts include metal salts, such as alkali or alkaline earth salts, e.g., barium, calcium (e.g., calcium edetate), lithium, magnesium, potassium, sodium, and the like; other metal salts, such as aluminum, bismuth, iron, and zinc; as well as nontoxic ammonium, quaternary ammonium, and amine cations, including, but not limited to ammonium, tetramethylammonium, tetraethylammonium, methylamine, dimethylamine, trimethylamine, triethylamine, ethylamine, pyridinium, and the like. Other cationic salts include organic salts, such as chloroprocaine, choline, dibenzylethylenediamine, diethanolamine, ethylenediamine, methylglucamine, and procaine. Exemplary salts include pharmaceutically acceptable salts.

By "pharmaceutically acceptable salt" is meant a salt that is, within the scope of sound medical judgment, suitable for use in contact with the tissues of humans and animals without undue toxicity, irritation, allergic response and the like and are commensurate with a reasonable benefit/risk ratio.

By "pharmaceutically acceptable excipient" is meant any ingredient other than a compound or structure (e.g., any formulas, compounds, or compositions described herein) and having the properties of being nontoxic and non-inflammatory in a subject. Exemplary, non-limiting excipients include adjuvants, antiadherents, antioxidants, binders, carriers, coatings, compression aids, diluents, disintegrants, dispersing agents, dyes (colors), emollients, emulsifiers, fillers (diluents), film formers or coatings, flavors, fragrances, glidants (flow enhancers), isotonic carriers, lubricants, preservatives, printing inks, solvents, sorbents, stabilizers, suspensing or dispersing agents, surfactants, sweeteners, waters of hydration, or wetting agents. Any of the excipients can be selected from those approved, for example, by the United States Food and Drug Administration or other governmental agency as being acceptable for use in humans or domestic animals. Exemplary excipients include, but are not limited to alcohol, butylated hydroxytoluene (BHT), calcium carbonate, calcium phosphate (dibasic), calcium stearate, croscarmellose, cross-linked polyvinyl pyrrolidone, citric acid, crospovidone, cysteine, ethylcellulose, gelatin, glycerol, hydroxypropyl cellulose, hydroxypropyl methylcellulose, lactated Ringer's solution, lactose, magnesium stearate, maltitol, maltose, mannitol, methionine, methylcellulose, methyl paraben, microcrystalline cellulose, polyethylene glycol, polyol, polyvinyl pyrrolidone, povidone, pregelatinized starch, propyl paraben, retinyl palmitate, Ringer's solution, shellac, silicon dioxide, sodium carboxymethyl cellulose, sodium chloride injection, sodium citrate, sodium starch glycolate, sorbitol, starch (corn), stearic acid, stearic acid, sucrose, talc, titanium dioxide, vegetable oil, vitamin A, vitamin E, vitamin C, water, and xylitol.

By "isomer" is meant a molecule having the same molecular formula as the reference molecule. Exemplary isomers include stereoisomers, diastereomers, enantiomers, geometric isomers, tautomers, as well as mixtures thereof.

By an "effective amount" or a "sufficient amount" of an agent, as used herein, is that amount sufficient to effect beneficial or desired results, such as clinical results, and, as such, an "effective amount" depends upon the context in which it is being applied. For example, in the context of administering an agent that is a repressor of a gene, an effective amount of an agent is, for example, an amount sufficient to achieve a reduction in that gene's expression, as compared to the response obtained without administration of the agent.

By "subject" is meant a human, a non-human animal (e.g., a mammal), a host (e.g., a subject exposed to a pathogen, such as a human host exposed to a pathogen), a plant, a bacterium, or a pathogen (e.g., a virus, a phage, a bacterium, or a fungus).

By "treating" a disease, disorder, or condition in a subject is meant reducing at least one symptom of the disease, disorder, or condition by administrating a therapeutic agent to the subject. By "treating prophylactically" a disease, disorder, or condition in a subject is meant reducing the frequency of occurrence of or reducing the severity of a disease, disorder or condition by administering a therapeutic agent to the subject prior to the onset of disease symptoms. Beneficial or desired results can include, but are not limited to, alleviation or amelioration of one or more symptoms or conditions; diminishment of extent of disease, disorder, or condition; stabilized (i.e., not worsening) state of disease, disorder, or condition; preventing spread of disease, disorder, or condition; delay or slowing the progress of the disease, disorder, or condition; amelioration or palliation of the disease, disorder, or condition; and remission (whether partial or total), whether detectable or undetectable.

In accordance with the present invention there may be employed conventional molecular biology, microbiology, and recombinant DNA techniques within the skill of the art. Such techniques are explained fully in the literature. See, e.g., Sambrook et al., 2001, "Molecular Cloning: A Laboratory Manual"; Ausubel, ed., 1994, "Current Protocols in Molecular Biology" Volumes I-III; Celis, ed., 1994, "Cell Biology: A Laboratory Handbook" Volumes I-III; Coligan, ed., 1994, "Current Protocols in Immunology" Volumes I-III; Gait ed., 1984, "Oligonucleotide Synthesis"; Hames & Higgins eds., 1985, "Nucleic Acid Hybridization"; Hames & Higgins, eds., 1984, "Transcription And Translation"; Freshney, ed., 1986, "Animal Cell Culture"; IRL.

The terms "polynucleotide" and "nucleic acid," used interchangeably herein, refer to a polymeric form of nucleotides of any length, either ribonucleotides or deoxyribonucleotides. Thus, this term includes, but is not limited to, single-stranded (e.g., sense or antisense), double-stranded, or multi-stranded ribonucleic acids (RNAs), deoxyribonucleic acids (DNAs), threose nucleic acids (TNAs), glycol nucleic acids (GNAs), peptide nucleic acids (PNAs), locked nucleic acids (LNAs), or hybrids thereof, genomic DNA, cDNA, DNA-RNA hybrids, or a polymer comprising purine and pyrimidine bases or other natural, chemically or biochemically modified, non-natural, or derivatized nucleotide bases. Polynucleotides can have any useful two-dimensional or three-dimensional structure or motif, such as regions including one or more duplex, triplex, quadruplex, hairpin, and/or pseudoknot structures or motifs. Any sequence with uracil may be substituted with thymine and vice versa.

The term "modified," as used in reference to nucleic acids, means a nucleic acid sequence including one or more modifications to the nucleobase, nucleoside, nucleotide, phosphate group, sugar group, and/or internucleoside linkage (e.g., phosphodiester backbone, linking phosphate, or a phosphodiester linkage).

The nucleoside modification may include, but is not limited to, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, and combinations thereof.

A sugar modification may include, but is not limited to, a locked nucleic acid (LNA, in which the 2'-hydroxyl is connected by a $C_{1-6}$ alkylene (e.g., a multivalent (e.g., bivalent, trivalent, tetravalent, etc.) form of an alkyl group) or $C_{1-6}$ heteroalkylene (e.g., a divalent form of an alkylene group containing one, two, three, or four non carbon heteroatoms (e.g., independently selected from the group consisting of nitrogen, oxygen, phosphorous, sulfur, or halo) bridge to the 4'-carbon of the same ribose sugar), replacement of the oxygen in ribose (e.g., with S, Se, or alkylene, such as methylene or ethylene), addition of a double bond (e.g., to replace ribose with cyclopentenyl or cyclohexenyl), ring contraction of ribose (e.g., to form a 4-membered ring of cyclobutane or oxetane), ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone), multicyclic forms (e.g., tricyclic), and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with a-L-threo-furanosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar.

A backbone modification may include, but is not limited to, 2'-deoxy- or 2'-O-methyl modifications. Exemplary modifications include modifications to the 2' position of a nucleic acid, such as 2'-O-methyl, 2'-halo (e.g., 2'-fluoro, 2'-chloro, etc.), 2'-alkyl (e.g., 2'-methyl, 2'-ethyl, 2'-propyl, 2'-allyl, etc.), 2'-aryl (e.g., 2'-phenyl), 2'-alkaryl (e.g., 2'-benzyl), 2'-amino (e.g., 2'-NH$_2$, 2'-NR$^{N1}$R$^{N2}$, which each of R$^{N1}$ and R$^{N2}$ is, independently, H, alkyl, or alkaryl), 2'-alkoxy (e.g. 2'-O-methoxy, 2'-O-ethoxy, etc.), 2'-alkylamine (e.g., 2'-O-methylamine, 2'-O-ethylamine, etc.), 2'-O-alkylamine (e.g., 2'-O-methylamine, 2'-O-ethylamine, etc.), 2'-azido, 2'-O-cyanoalkyl (e.g., 2'-O-cyanomethyl), 2'-O-alkoxylalkyl (e.g., 2'-O-(2-methoxyethyl)), etc. A phosphate group modification may include, but is not limited to, phosphorothioate, phosphoroselenates, boranophosphates, boranophosphate esters, hydrogen phosphonates, phosphoramidates, phosphorodiamidates, alkyl or aryl phosphonates, phosphotriesters, phosphorodithioates, bridged phosphoramidates, bridged phosphorothioates, or bridged methylene-phosphonates.

"Complementarity" or "complementary" refers to the ability of a nucleic acid to form hydrogen bond(s) with another nucleic acid sequence by either traditional Watson-Crick or other non-traditional types, e.g., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. As is known in the art, standard Watson-Crick base-pairing includes: adenine (A) pairing with thymidine (T), adenine (A) pairing with uracil (U), and guanine (G) pairing with cytosine (C). In addition, it is also known in the art that for hybridization between two RNA molecules (e.g., dsRNA), guanine (G) base pairs with uracil (U). A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" or "sufficient complementarity" as used herein refers to a degree of complementarity that is at least 60%, 65%, 70%, 75%, 80%, 85%, 90%, 95%. 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions.

As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part 1, Second Chapter "Overview of principles of hybridization and the strategy of nucleic acid probe assay", Elsevier, N.Y.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. Hybridization and washing conditions are well known and exemplified in Sambrook J, Fritsch E F, and Maniatis T, "Molecular Cloning: A Laboratory Manual," Second Edition, Cold Spring Harbor Laboratory Press, Cold Spring Harbor (1989), particularly Chapter 11 and Table 11.1 therein; and Sambrook J and Russell W, "Molecular Cloning: A Laboratory Manual," Third Edition, Cold Spring Harbor Laboratory Press, Cold Spring Harbor (2001). The conditions of temperature and ionic strength determine the "stringency" of the hybridization.

Hybridization requires that the two nucleic acids contain complementary sequences, although mismatches between bases are possible. The conditions appropriate for hybridization between two nucleic acids depend on the length of the nucleic acids and the degree of complementation, variables well known in the art. The greater the degree of complementation between two nucleotide sequences, the greater the value of the melting temperature (Tm) for hybrids of nucleic acids having those sequences. For hybridizations between nucleic acids with short stretches of complementarity (e.g., complementarity over 35 or less, 30 or less, 25 or less, 22 or less, 20 or less, or 18 or less nucleotides) the position of mismatches becomes important (see Sambrook et al., supra, 11.7-11.8). Typically, the length for a hybridizable nucleic acid is at least about 10 nucleotides. Illustrative minimum lengths for a hybridizable nucleic acid are: at least about 15 nucleotides; at least about 20 nucleotides; at least about 22 nucleotides; at least about 25 nucleotides; and at least about 30 nucleotides). Furthermore, the skilled artisan will recognize that the temperature and wash solution salt concentration may be adjusted as necessary according to factors such as length of the region of complementation and the degree of complementation.

It is understood in the art that the sequence of polynucleotide need not be 100% complementary to that of its target nucleic acid to be specifically hybridizable or hybridizable. Moreover, a polynucleotide may hybridize over one or more segments such that intervening or adjacent segments are not involved in the hybridization event (e.g., a loop structure or hairpin structure). A polynucleotide can comprise at least 70%, at least 80%, at least 90%, at least 95%, at least 99%, or 100% sequence complementarity to a target region within the target nucleic acid sequence to which they are targeted. For example, an antisense nucleic acid in which 18 of 20 nucleotides of the antisense compound are complementary to a target region, and would therefore specifically hybridize, would represent 90 percent complementarity. In this example, the remaining noncomplementary nucleotides may be clustered or interspersed with complementary nucleotides and need not be contiguous to each other or to complementary nucleotides. Percent complementarity between particular stretches of nucleic acid sequences within nucleic acids can be determined routinely using BLAST programs (basic local alignment search tools) and PowerBLAST programs known in the art (Altschul S F et al., J. Mol. Biol. 1990; 215:403-10; Zhang J et al., Genome Res. 1997; 7:649-56) or by using the Gap program (Wisconsin Sequence Analysis Package, Version 8 for Unix, Genetics Computer Group, University Research Park, Madison Wis.), using default settings, which uses the algorithm of Smith T F et al., Adv. Appl. Math. 1981; 2(4):482-9).

By "protein," "peptide," or "polypeptide," as used interchangeably, is meant any chain of more than two amino acids, regardless of post-translational modification (e.g., glycosylation or phosphorylation), constituting all or part of a naturally occurring polypeptide or peptide, or constituting a non-naturally occurring polypeptide or peptide, which can include coded amino acids, non-coded amino acids, modified amino acids (e.g., chemically and/or biologically modified amino acids), and/or modified backbones.

The term "fragment" is meant a portion of a nucleic acid or a polypeptide that is at least one nucleotide or one amino acid shorter than the reference sequence. This portion contains, preferably, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, 1000, 1250, 1500, 1750, 1800, or more nucleotides; or 10, 20, 30, 40, 50, 60, 70, 80, 90, 100, 150, 200, 250, 300, 350, 400, 450, 500, 550, 600, 640, or more amino acids. In another example, any polypeptide fragment can include a stretch of at least about 5 (e.g., about 10, about 20, about 30, about 40, about 50, or about 100) amino acids that are at least about 40% (e.g., about 50%, about 60%, about 70%, about 80%, about 90%, about 95%, about 87%, about 98%, about 99%, or about 100%) identical to any of the sequences described herein can be utilized in accordance with the invention. In certain embodiments, a polypeptide to be utilized in accordance with the invention includes 2, 3, 4, 5, 6, 7, 8, 9, 10, or more mutations (e.g., one or more conservative amino acid substitutions, as described herein). In yet another example, any nucleic acid fragment can include a stretch of at least about 5 (e.g., about 7, about 8, about 10, about 12, about 14, about 18, about 20, about 24, about 28, about 30, or more) nucleotides that are at least about 40% (about 50%, about 60%, about 70%, about 80%, about 90%, about 95%, about 87%, about 98%, about 99%, or about 100%) identical to any of the sequences described herein can be utilized in accordance with the invention.

The term "conservative amino acid substitution" refers to the interchangeability in proteins of amino acid residues having similar side chains (e.g., of similar size, charge, and/or polarity). For example, a group of amino acids having aliphatic side chains consists of glycine, alanine, valine, leucine, and isoleucine; a group of amino acids having aliphatic-hydroxyl side chains consists of serine and threonine; a group of amino acids having amide containing side chains consisting of asparagine and glutamine; a group of amino acids having aromatic side chains consists of phenylalanine, tyrosine, and tryptophan; a group of amino acids having basic side chains consists of lysine, arginine, and histidine; a group of amino acids having acidic side chains consists of glutamic acid and aspartic acid; and a group of amino acids having sulfur containing side chains consists of cysteine and methionine. Exemplary conservative amino acid substitution groups are valine-leucine-isoleucine, phenylalanine-tyrosine, lysine-arginine, alanine-valine, glycine-serine, glutamate-aspartate, and asparagine-glutamine.

As used herein, when a polypeptide or nucleic acid sequence is referred to as having "at least X % sequence identity" to a reference sequence, it is meant that at least X percent of the amino acids or nucleotides in the polypeptide or nucleic acid are identical to those of the reference sequence when the sequences are optimally aligned. An optimal alignment of sequences can be determined in various ways that are within the skill in the art, for instance, the Smith Waterman alignment algorithm (Smith T F et al., J. Mol. Biol. 1981; 147:195-7) and BLAST (Basic Local Alignment Search Tool; Altschul S F et al., J. Mol. Biol. 1990; 215:403-10). These and other alignment algorithms are accessible using publicly available computer software such as "Best Fit" (Smith T F et al., Adv. Appl. Math. 1981; 2(4):482-9) as incorporated into GeneMatcher Plus™ (Schwarz and Dayhof, "Atlas of Protein Sequence and Structure," ed. Dayhoff, M. O., pp. 353-358, 1979), BLAST, BLAST-2, BLAST-P, BLAST-N, BLAST-X, WU-BLAST-2, ALIGN, ALIGN-2, CLUSTAL, T-COFFEE, MUSCLE, MAFFT, or Megalign (DNASTAR). In addition, those skilled in the art can determine appropriate parameters for measuring alignment, including any algorithms needed to achieve optimal alignment over the length of the sequences being compared. In general, for polypeptides, the length of comparison sequences can be at least five amino acids, preferably 10, 20, 30, 40, 50, 60, 70, 80, 90, 100, 125, 150, 175, 200, 250, 300, 400, 500, 600, 700, or more amino acids, up to the entire length of the polypeptide. For nucleic acids, the length of comparison sequences can generally be at least 10, 20, 30, 40, 50, 60, 70, 80, 90, 100, 125, 150, 175, 200, 250, 300, 400, 500, 600, 700, 800, 900, 1000, 1100, 1200, 1300, 1400, 1500, 1600, 1700, 1800, 1900, 2000, 2100, or more nucleotides, up to the entire length of the nucleic acid molecule. It is understood that for the purposes of determining sequence identity when comparing a DNA sequence to an RNA sequence, a thymine nucleotide is equivalent to a uracil nucleotide.

By "substantial identity" or "substantially identical" is meant a polypeptide or nucleic acid sequence that has the same polypeptide or nucleic acid sequence, respectively, as a reference sequence, or has a specified percentage of amino acid residues or nucleotides, respectively, that are the same at the corresponding location within a reference sequence when the two sequences are optimally aligned. For example, an amino acid sequence that is "substantially identical" to a reference sequence has at least about 50%, 60%, 70%, 75%, 80%, 85%, 90%, 95%, 96%, 97%, 98%, 99%, or 100% sequence identity to the reference amino acid sequence. For polypeptides, the length of comparison sequences will generally be at least 5, 6, 7, 8, 9, 10, 11, 12, 13, 14, 15, 16, 17, 18, 19, 20, 25, 50, 75, 90, 100, 150, 200, 250, 300, or 350 contiguous amino acids (e.g., a full-length sequence). For nucleic acids, the length of comparison sequences will generally be at least 5, 10, 11, 12, 13, 14, 15, 16, 17, 18, 19, 20, 21, 22, 23, 24, or 25 contiguous nucleotides (e.g., the full-length nucleotide sequence). Sequence identity may be measured using sequence analysis software on the default setting (e.g., Sequence Analysis Software Package of the Genetics Computer Group, University of Wisconsin Biotechnology Center, 1710 University Avenue, Madison, Wis., 53705). Such software may match similar sequences by assigning degrees of homology to various substitutions, deletions, and other modifications.

A "target sequence" as used herein is a polynucleotide (e.g., as defined herein, including a DNA, RNA, or DNA/RNA hybrid, as well as modified forms thereof and single-stranded forms thereof) that includes a "target site." The term "target site" refers to a nucleic acid sequence present in a target genomic sequence (e.g., ssDNA or ssRNA in a host or pathogen) to which a targeting portion of the guiding component will bind provided sufficient conditions (e.g., sufficient complementarity) for binding exist. Suitable DNA/RNA binding conditions include physiological conditions normally present in a cell. Other suitable DNA/RNA binding conditions (e.g., conditions in a cell-free system) are known in the art; see, e.g., Sambrook, supra.

By "cleavage" it is meant the breakage of the covalent backbone of a target sequence (e.g., a nucleic acid molecule). Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends. In certain embodiments, a complex comprising a guiding component and a nuclease is used for targeted double-stranded DNA cleavage. In other embodiments, a complex comprising a guiding component and a nuclease is used for targeted single-stranded RNA cleavage.

"Nuclease" and "endonuclease" are used interchangeably herein to mean an enzyme which possesses catalytic activity for cleavage of a nucleic acid sequence.

By "cleavage domain" or "active domain" or "nuclease domain" of a nuclease it is meant the polypeptide sequence or domain within the nuclease which possesses the catalytic activity for nucleic acid cleavage. A cleavage domain can be contained in a single polypeptide chain or cleavage activity can result from the association of two (or more) polypeptides. A single nuclease domain may consist of more than one isolated stretch of amino acids within a given polypeptide.

By "linker" is meant any useful multivalent (e.g., bivalent) component useful for joining to different portions or segments. Exemplary linkers include a bond (e.g., a covalent bond), a nucleic acid sequence, a chemical linker, etc. In one instance, the linker of the synthetic guiding component can have a length of from about 3 nucleotides to about 100 nucleotides. For example, the linker can have a length of from about 3 nucleotides (nt) to about 90 nt, from about 3 nucleotides (nt) to about 80 nt, from about 3 nucleotides (nt) to about 70 nt, from about 3 nucleotides (nt) to about 60 nt, from about 3 nucleotides (nt) to about 50 nt, from about 3 nucleotides (nt) to about 40 nt, from about 3 nucleotides (nt) to about 30 nt, from about 3 nucleotides (nt) to about 20 nt or from about 3 nucleotides (nt) to about 10 nt. For example, the linker can have a length of from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a synthetic guiding component is 4 nt.

A "vector" or "expression vector" is a replicon, such as plasmid, phage, virus, or cosmid, to which another nucleic acid segment, i.e., an "insert", may be attached so as to bring about the replication of the attached segment in a cell.

As used herein, the terms "top," "bottom," "upper," "lower," "above," and "below" are used to provide a relative relationship between structures. The use of these terms does not indicate or require that a particular structure must be located at a particular location in the apparatus.

Other features and advantages of the invention will be apparent from the following description and the claims.

BRIEF DESCRIPTION OF THE DRAWINGS

FIG. 7A-7D shows that SauCas9 prefers a complementary region of 23 nt for binding and cleavage. Diagram of pUC ssRNA target (SEQ ID NO:12) and regions of complementary for the different length sgRNAs (SEQ ID NOs:300-306) (FIG. 7A). Representative in vitro cleavage assays using sgRNAs with a complementary region to the target of the indicated lengths (FIG. 7B). Time points are 0, 1, 2, 5, 10, 30, 60, and 120 mins. T1 RNase digest size fragments are given on the left. Quantification of cleavage products (FIG. 7C) from reactions in FIG. 7B. Length of targeting region of the sgRNA given as n-mer. Fit was determined in Prism using a single-exponential decay model. Error bars represent the mean±S.D. (n=3). Filter binding data for dSauCas9 and the structured RNA substrates were fit in Prism using a one-site binding model (FIG. 7D) and the apparent dissociation constant ($K_{d,app}$) was determined. Bars represent the mean±S.D. (n=3).

FIG. 11A-11D shows that enriched guides do not display sequence bias and cluster to regions on the MS2 genome. Stacked bar graph of positively enriched guides (FDR-adjusted p-value <0.05) for perfectly complementary and single-nucleotide mismatch (SNP) guides for a multiplicities of infection (MOI) of 10 and 100 (FIG. 11A, left). Percentages of perfect and SNP guides by length averaged across the control libraries (n=3) (FIG. 11A, right). WebLogo (see, e.g., Crooks G E et al., *Genome Res.* 2004; 14(6):1188-90)

Figure 11C:
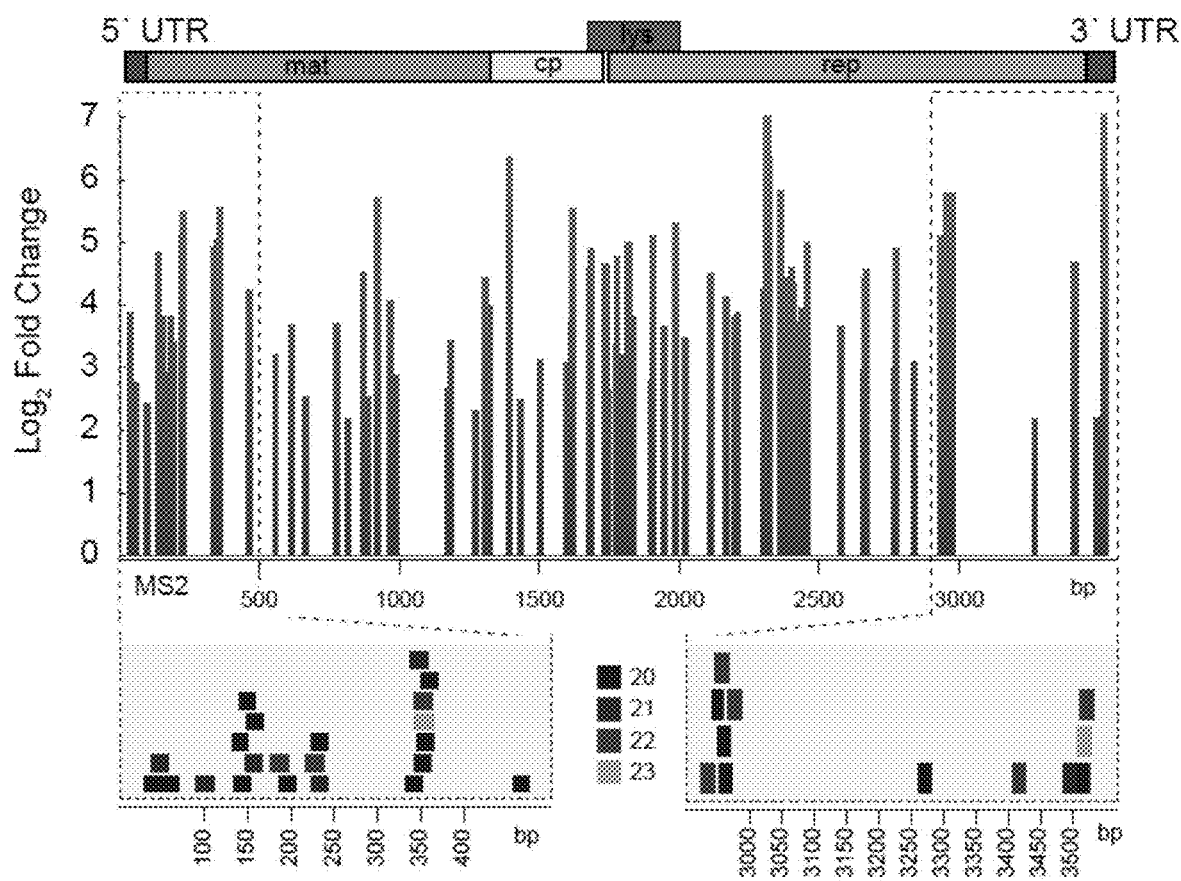
Figure 11D:
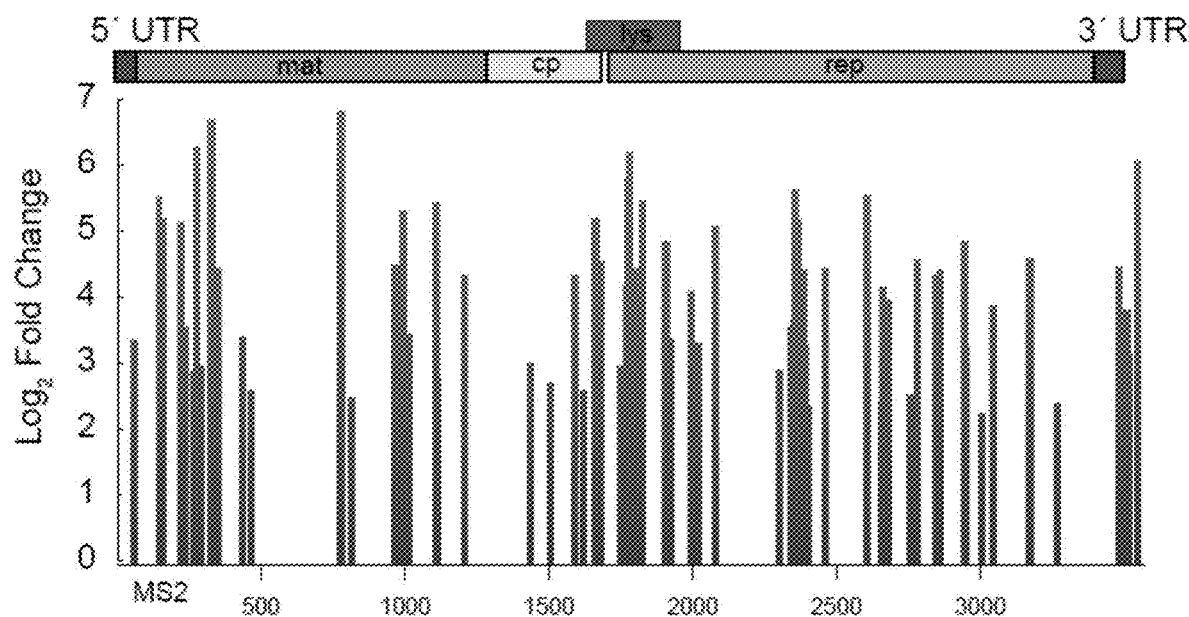

representation of positively enriched guides (perfect complementarity, FDR-adjusted p-value <0.05) for MOI-10 (n=84) and MOI-100 (n=107) (FIG. 11B). Different length guides were aligned at their 3' end, which contains the pre-ordered 'seed' region. $Log_2$ fold-change of positively enriched guides (FDR-adjusted p-value <0.05) mapped to the MS2 genome for MOI-100 treatment (FIG. 11C, upper). Schematic of MS2 genome is provided above. Individual guides mapped to highlighted regions of MS2 genome (FIG. 11C, lower). $Log_2$ fold-change of guides with an FDR-adjusted p-value <0.05 mapped to the MS2 genome for MOI-10 treatment (FIG. 11D).

Figure 12:
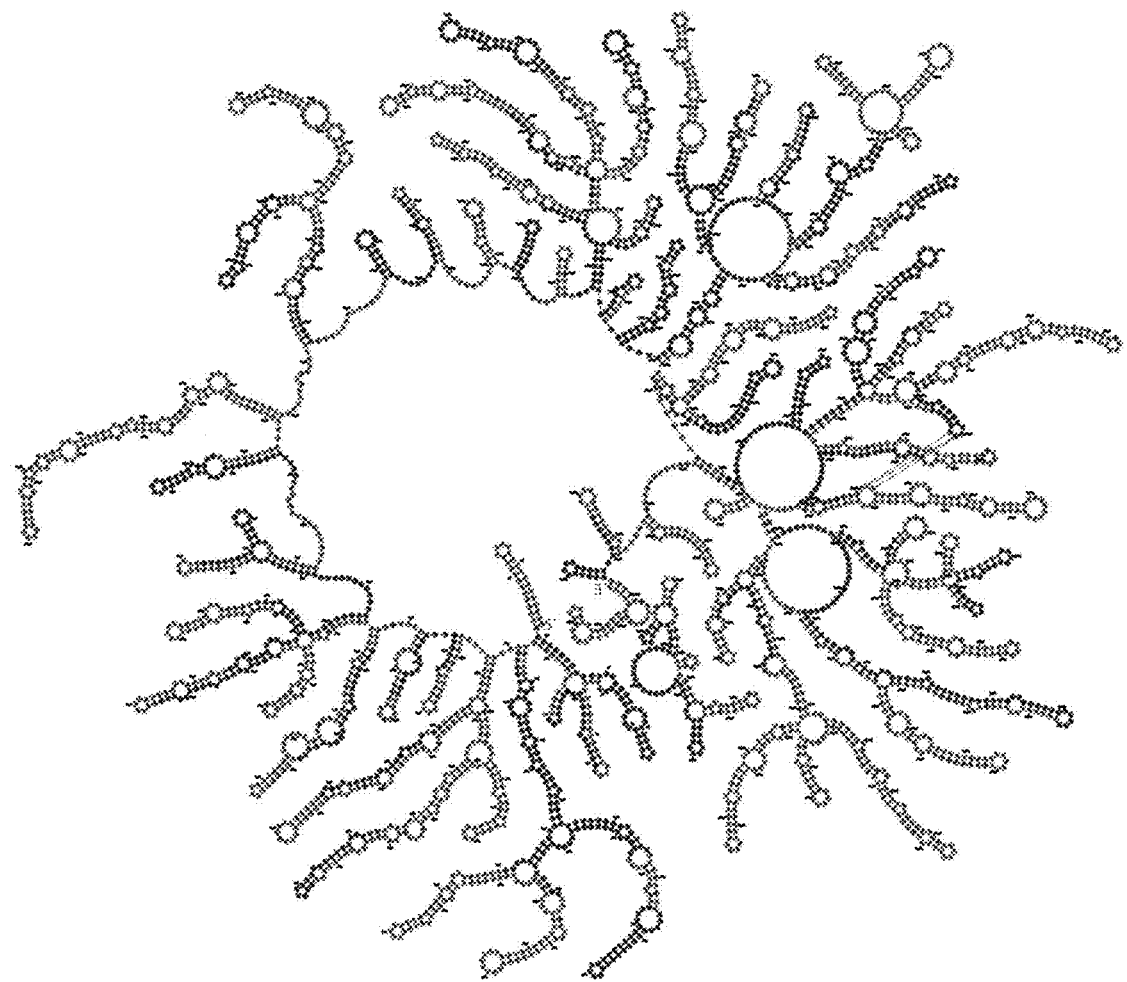

FIG. 12 shows enriched MS2 targeting guides mapped to MS2 genome structure. Structure of the MS2 genome inside the viral particle was obtained from a recently published EM structure (see, e.g., Dai X et al., *Nature* 2017; 541(7635): 112-6) and guides (red) significantly enriched in the MOI-100 treatment (FDR-adjusted p-value <0.05) were mapped to the MS2 genome and subsequently visualized in Forna (see, e.g., Kerpedjiev P et al., Bioinformatics 2015; 31(20): 3377-9).

Figure 13A:
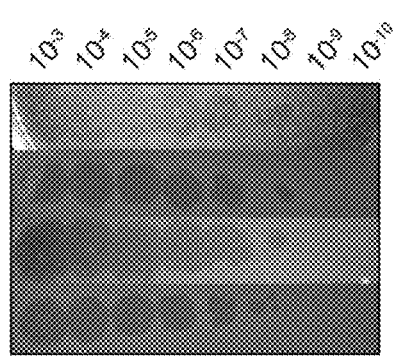
Figure 13B:
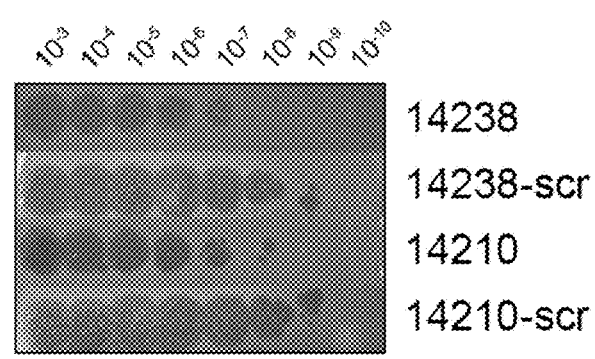
Figure 13C:
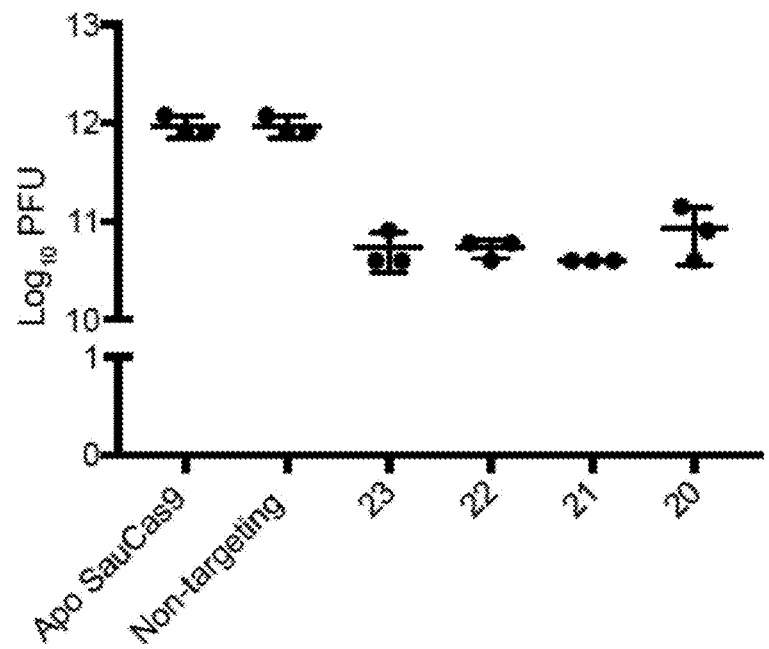
Figure 13D:
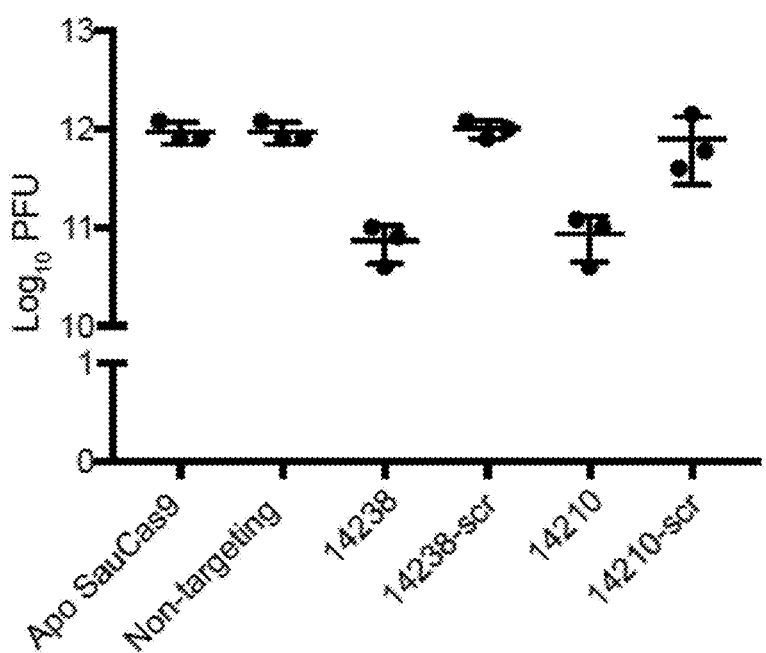
Figure 13E:
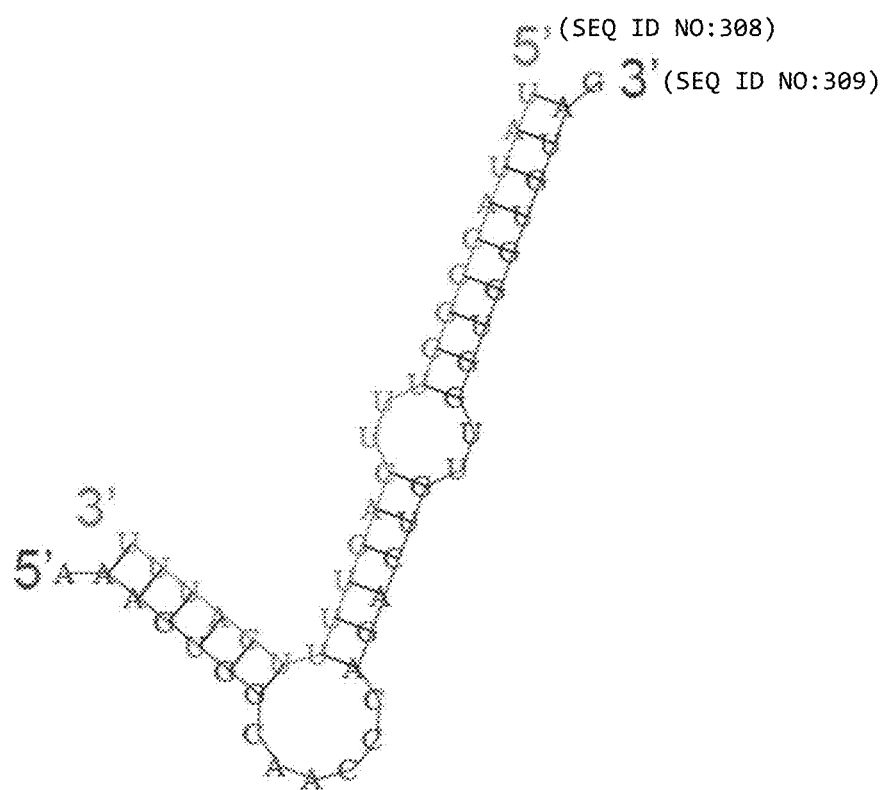

FIG. 13A-13E shows confirmation that enriched guides from the MS2 screen confer protection against MS2 infection. Representative plaque assay for lawns of *E. coli* expressing wtSauCas9 and sgRNA of different length spotted with phage dilutions indicated (FIG. 13A-13B). Here, the sgRNA with the highest fold-change in both MOI-10 and -100 samples was chosen for each length. The 23-mer sgRNA produces hazy plaques for an unknown reason. All other guides tested, including a different 23-mer sgRNA, produced clear plaques. In FIG. 13B, guides were two 'control' guides that were significantly enriched in both MOI-10 and MOI-100 treatments during phage selection. Scrambled (scr) indicates random shuffling of the target sequence to serve as a non-targeting control. Scrambled sequences were verified against the MS2 genome and its reverse-complement to ensure no partial matches. Quantification of relative PFUs (mean±S.D., n=3) (FIG. 13C-13D) from data in FIG. 13A-13B, respectively. In FIG. 13D, guides 14238 and 14210 confer ~10-fold protection over their scrambled counterparts. The level of protection was similar to perfectly complementary guides in FIG. 13C (see also FIG. 10E-10F). Predicted binding (FIG. 13E) of guide 14238 (green, SEQ ID NO:308) to a fragment of the MS2 genome (red, nts: 1533-1563, SEQ ID NO:309) using RNAhybrid (see, e.g., Rehmsmeier M et al., RNA 2004; 10(10):1507-17).

Figure 14A:
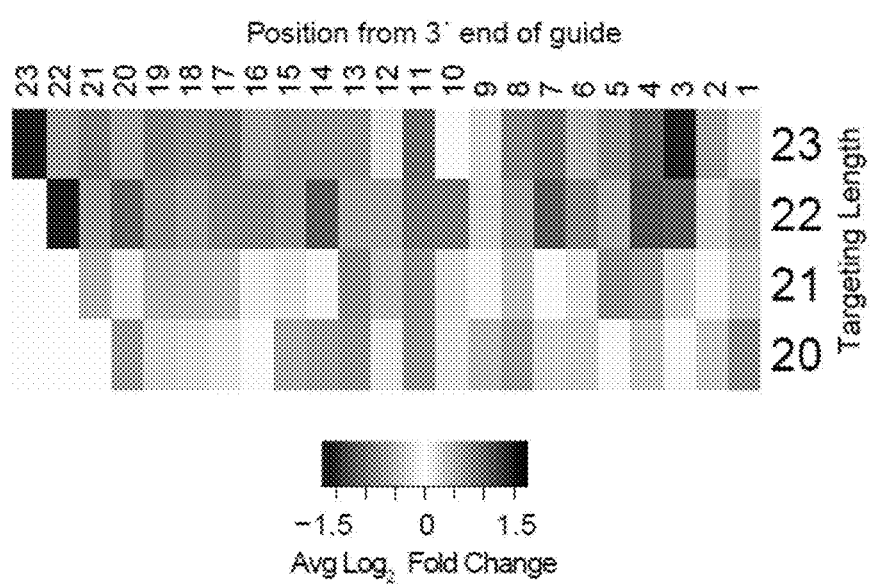
Figure 14B:
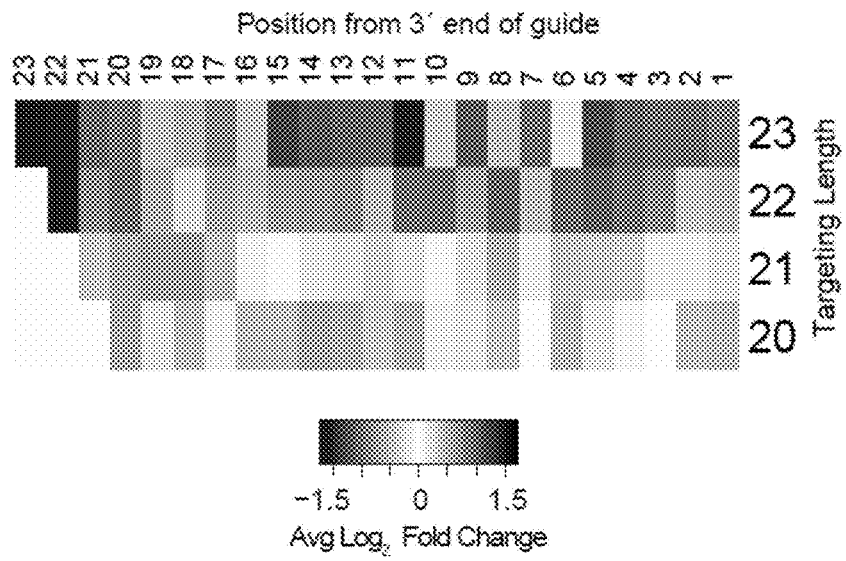
Figure 14C:
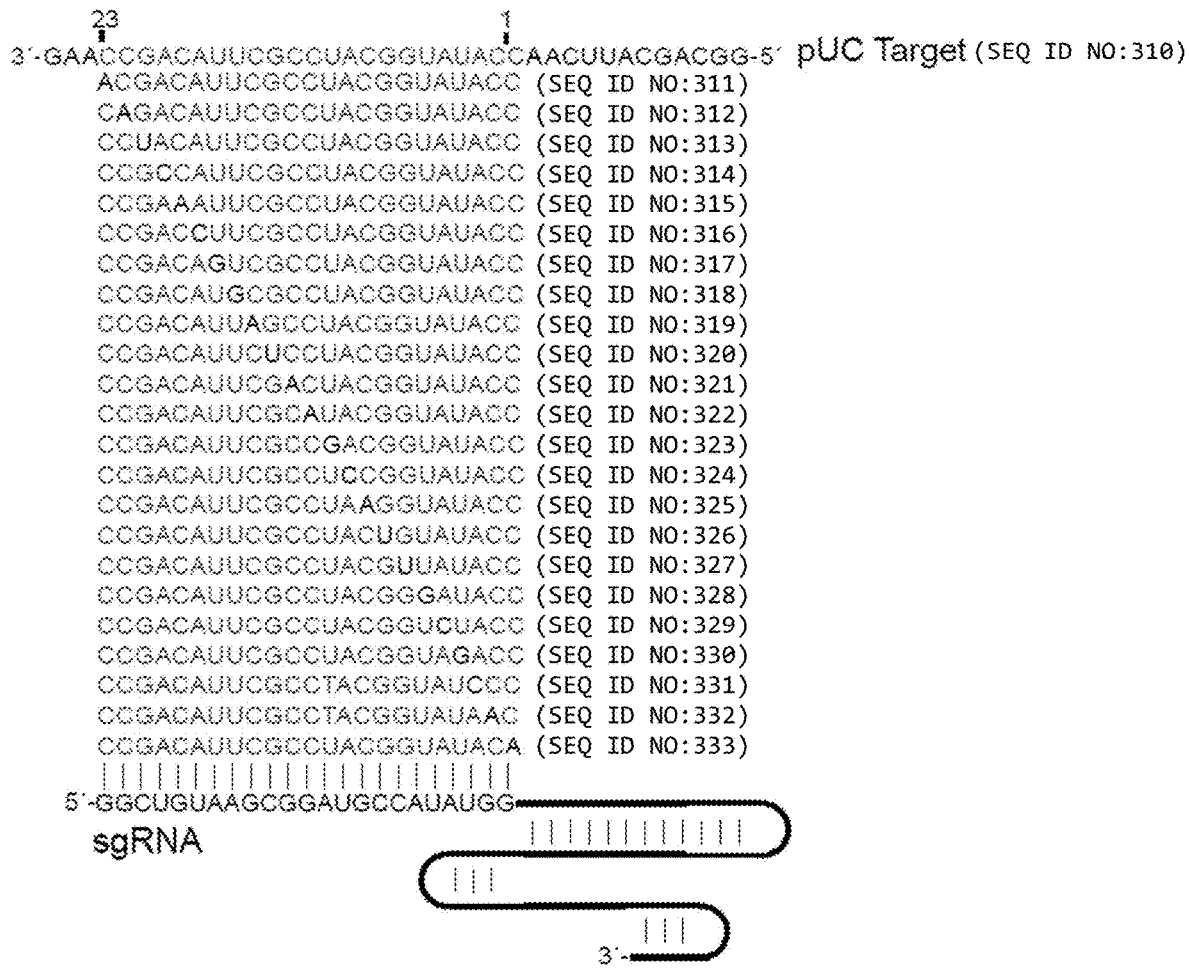

FIG. 14A-14D shows the effect of single-nucleotide mismatches on ssRNA targeting. Heatmap of average $log_2$ fold-change for all single-nucleotide mismatch (SNP) guides in MOI-10 (FIG. 14A) and MOI-100 (FIG. 14B) treatment. Deeper blue represents greater negative selection of guides indicating greater sensitivity to mismatches at that position, while deeper black represents greater positive selection indicating that mismatches at that position are more tolerated. Positions are given as distance from 3' end of the targeting region of the sgRNA. Diagram of target ssRNAs with SNPs (SEQ ID NO 2:311-333) for in vitro cleavage assays, as compared to the pUC target (SEQ ID NO:310) (FIG. 14C). Red highlights the region complementary to the guide while black nucleotides indicate the mismatched base in the targeting region. Numbering of nucleotides is labeled from 1 to 23 to reflect positions in FIG. 14A-14B. Quantification of in vitro cleavage assays (FIG. 14D) with mismatched targets in FIG. 14C. Bars represent the mean±S.D. (n=3). "Wt" indicates 23 nt of perfect complementarity between the sgRNA and the target.

Figure 15A:
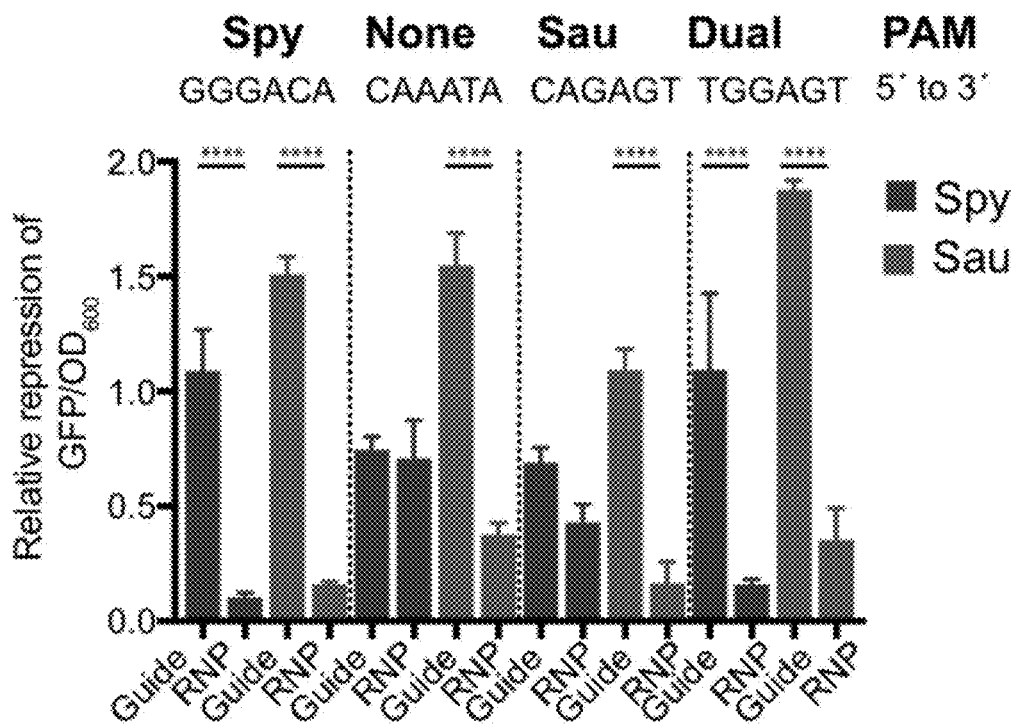
Figure 15D:
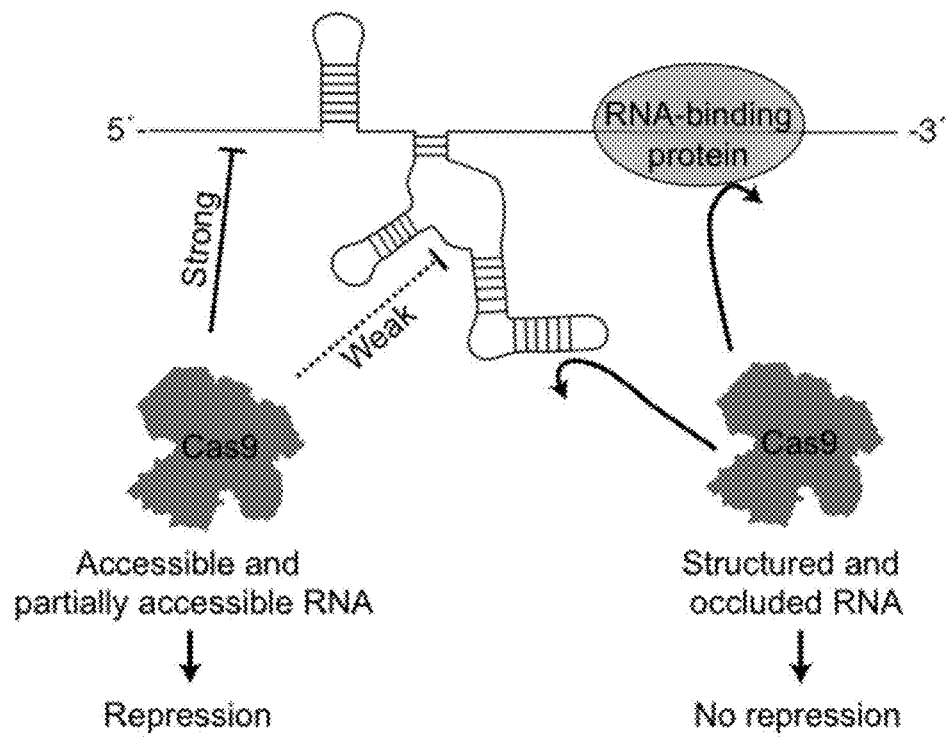

FIG. 15A-15D shows SauCas9 repression of a GFP reporter in vivo. Comparison of dSpyCas9 and dSauCas9 to repress GFP expression on the DNA and RNA level (FIG. 15A). GFP signal was normalized to $OD_{600}$ to control for difference in cell density between samples. $GFP/OD_{600}$ ratios for guide alone and RNP are normalized to values for a non-targeting guide vector and an Apo protein control, respectively. Target sites were chosen to be adjacent to PAM sites for Spy, Sau, both, or neither as indicated. Note: the slight GFP repression observed with dSpyCas9 using the target sequence adjacent to the Sau PAM (CAGAGT) likely results from the ability of SpyCas9 to use an NAG PAM, albeit with reduced efficiency (see, e.g., Hsu P D et al., Nat. Biotechnol. 2013; 31(9):827-32). ****p<0.0001 by one-way ANOVA. Relative expression of GFP using guides with different length targeting sequences (FIG. 15B). Target site here is the GFP2 sequence chosen for its robust targeting activity. Diagram of targeting sequences across the GFP mRNA and ribosome binding site (RBS) (FIG. 15C, upper). Relative expression of GFP of SauCas9 RNP normalized to sgRNA alone for targeting sequences across the GFP reporter (FIG. 15C, lower). Dashed red line indicates that the sgRNA alone is as efficient as the RNP for GFP repression. Bars in FIG. 15A-15C represent mean±S.D. (n=3). Non-limiting model for observed SauCas9 ssRNA targeting activity (FIG. 15D). We propose that accessible RNA is cleaved or repressed efficiently while structured and protein-bound RNA is not targeted by SauCas9.

Figure 16A:
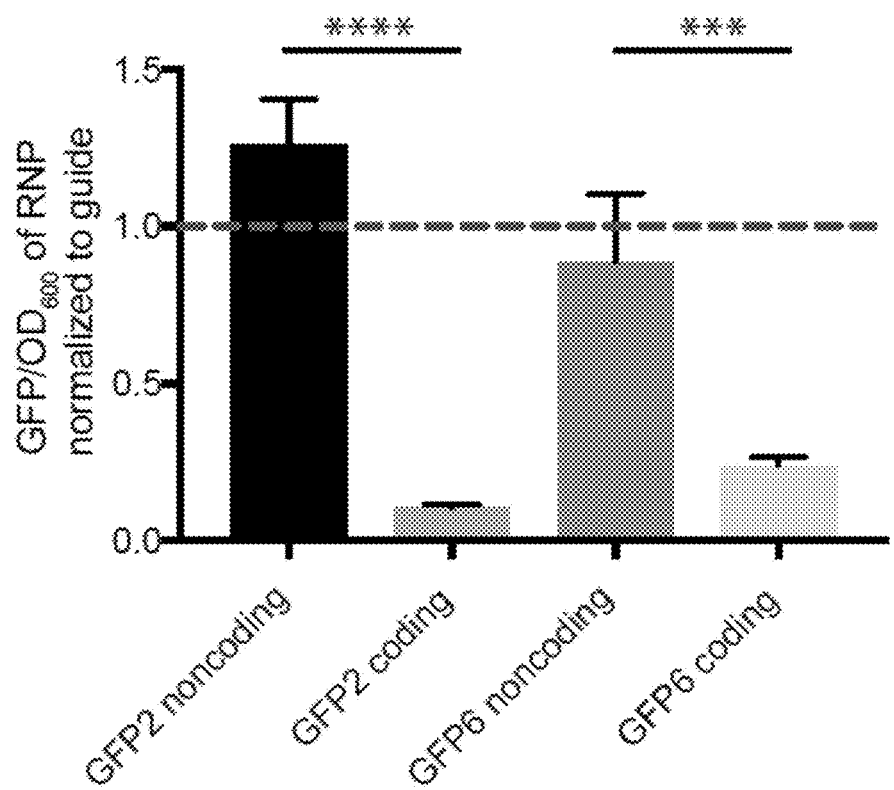
Figure 16B:
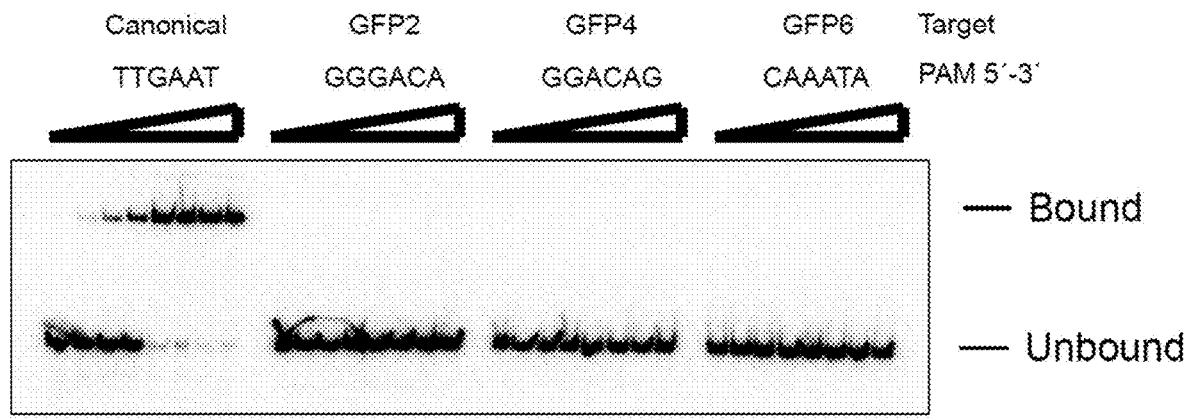
Figure 16C:
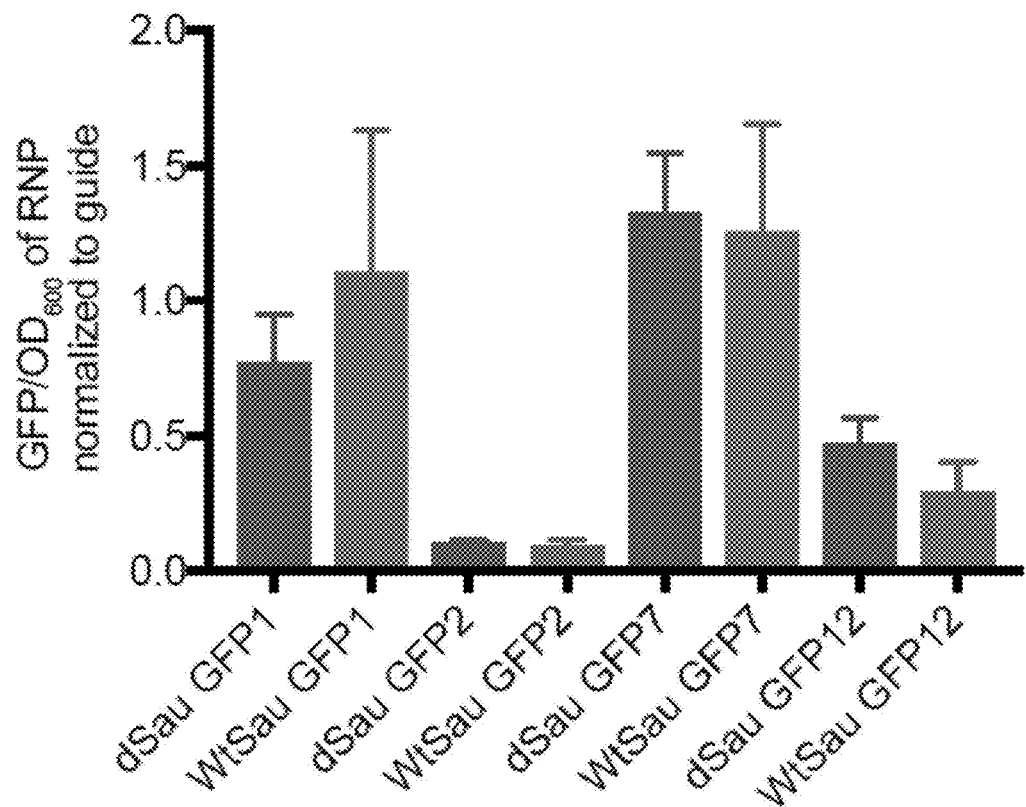

FIG. 16A-16C shows repression of GFP mRNA. dSauCas9-sgRNA directed against a GFP mRNA (coding) or antisense (noncoding) sequence (FIG. 16A). GFP2 and GFP6 refer to guides diagrammed in FIG. 15C. Dashed red line indicates that the sgRNA alone is as efficient as the SauCas9 RNP for GFP repression. Bars represent mean±S.D. (n=3). *p<0.001, **p<0.0001, by one-way ANOVA. Electrophoretic mobility shift assay (EMSA) confirming that dSauCas9 does not bind dsDNA adjacent to non-canonical PAMs (FIG. 16B). Targeting sequence was identical for all substrates but with varied PAM sequences as indicated for the guides in FIG. 15C. Final concentrations of dSauCas9 from left to right: 0, 0.1, 0.5, 1, 5, 10, 50, 100 nM. Comparison of ability of dSau and wtSauCas9 to repress GFP expression in vivo (FIG. 16C). Bars represent mean±S.D. (n=3).

FIG. 17A-17E shows exemplary protein sequences for Cas9 proteins (from the N to C terminus). Provided are protein sequences for wild-type *Staphylococcus aureus* Cas9 (SauCas, SEQ ID NO:100) (FIG. 17A), dSauCas9 (D10A and N580A, SEQ ID NO:101) (FIG. 17B), *Streptococcus pyogenes* Cas9 (SpyCas, SEQ ID NO:102) (FIG. 17C), *Francisella novicida* Cas9 (FnoCas9, SEQ ID NO:103) (FIG. 17D), and *Campylobacter jejuni* Cas9 (CjeCas9, SEQ ID NO:104) (FIG. 17E). Further protein sequences can include one or more of SEQ ID NOs:100-104, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:100-104 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 18A-18E shows exemplary single-guide RNA (sgRNA) constructs (from 5' to 3' end) employed in the Examples described herein. Provided are in vitro sgRNA constructs (SEQ ID NOs:1-11) (FIG. 18A), in vitro target sequences (SEQ ID NOs:12-39) (FIG. 18B), sgRNA constructs for MS2 plaque assays (SEQ ID NOs:40-52) (FIG. 18C), sgRNA constructs for GFP reporter expression assays (SEQ ID NOs:53-71) (FIG. 18D), and GFP repression targets (SEQ ID NOs:72-76) (FIG. 18E). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:1-76 or a fragment thereof.

FIG. 19A-19L shows further exemplary protein sequences for Cas9 proteins (from the N to C terminus). Provided are protein sequences for *Staphylococcus aureus* Cas9 (UniProtKB J7RUA5, SEQ ID NO:110) (FIG. 19A), *Campylobacter jejuni* subsp. *jejuni* serotype 0:2 Cas9 (UniProtKB Q0P897, SEQ ID NO:111) (FIG. 19B), *Streptococcus thermophilus* Cas9 (UniProtKB G3ECR1, SEQ ID NO:112) (FIG. 19C), *Streptococcus thermophilus* (strain ATCC BAA-491/LMD-9) Cas9-1 (UniProtKB Q03LF7, SEQ ID NO:113) (FIG. 19D), *Streptococcus thermophilus* (strain ATCC BAA-491/LMD-9) Cas9-2 (UniProtKB Q03JI6, SEQ ID NO:114) (FIG. 19E), *Wolinella succinogenes* Cas9 (UniProtKB Q7MRD3, SEQ ID NO:115) (FIG. 19F), *Wolinella succinogenes* Cas9/Csx12 (NCBI WP_011139431.1, SEQ ID NO:116) (FIG. 19G), *Staphylococcus lugdunensis* Cas9 (UniProtKB A0A133QCR3, SEQ ID NO:117) (FIG. 1911), *Staphylococcus pseudintermedius* ED99 Cas9 (GenBank ADX75954.1, SEQ ID NO:118) (FIG. 19I), *Helicobacter mustelae* Cas9 (UniProtKB D3UFL8, SEQ ID NO:119) (FIG. 19J), *Streptococcus pasteurianus* Cas9 (UniProtKB A0A135YMA6, SEQ ID NO:120) (FIG. 19K), and *Streptococcus pasteurianus* (strain ATCC 43144/JCM 5346/CDC 1723-81) Cas9 (UniProtKB F5X275, SEQ ID NO:121) (FIG. 19L). Further protein sequences can include one or more of SEQ ID NOs:110-121, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs: 110-121 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 20A-20J shows non-limiting synthetic guiding components. Provided are a schematic (FIG. 20A) of an exemplary synthetic guiding component 2000 (SEQ ID NO:5) including a first portion 2001 (e.g., a crRNA sequence, such as any described herein), a second portion 2002 (e.g., a tracrRNA sequence, such as any described herein), a target portion 2004, and a linker 2005 and a schematic (FIG. 20B) of the exemplary synthetic guiding component 2000 (SEQ ID NO:5) bound to a target site 2011 of an exemplary target sequence 2012 (SEQ ID NO:12). Also provided are non-limiting nucleic acid sequences (FIG. 20C-20J) that can be employed as a first portion, a linker, and/or a second portion (SEQ ID NOs:150-273). In one non-limiting instance, the synthetic guiding component has a structure provided by formula 5'-W—X—Y-L-Z-3', in which W is a third portion, X is a targeting portion, Y is a first portion, L is a linker, and Z is a second portion, as described herein. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:150-273 or a fragment thereof.

FIG. 21 shows further non-limiting synthetic guiding components, in which W is a third portion and X is a targeting portion, as described herein (SEQ ID NOs:274-293). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs: 274-293 or a fragment thereof.

DETAILED DESCRIPTION OF THE INVENTION

The present invention relates, in part, to a CRISPR-Cas based system for processing targets including single-stranded nucleic acid sequences. In particular embodiments, described herein are synthetic guiding components for binding and/or cleaving sequences include RNA or modified forms thereof. Such guiding components can be employed in conjunction with a nuclease (e.g., Cas9) that cleaves RNA sequences.

Figure 1A:
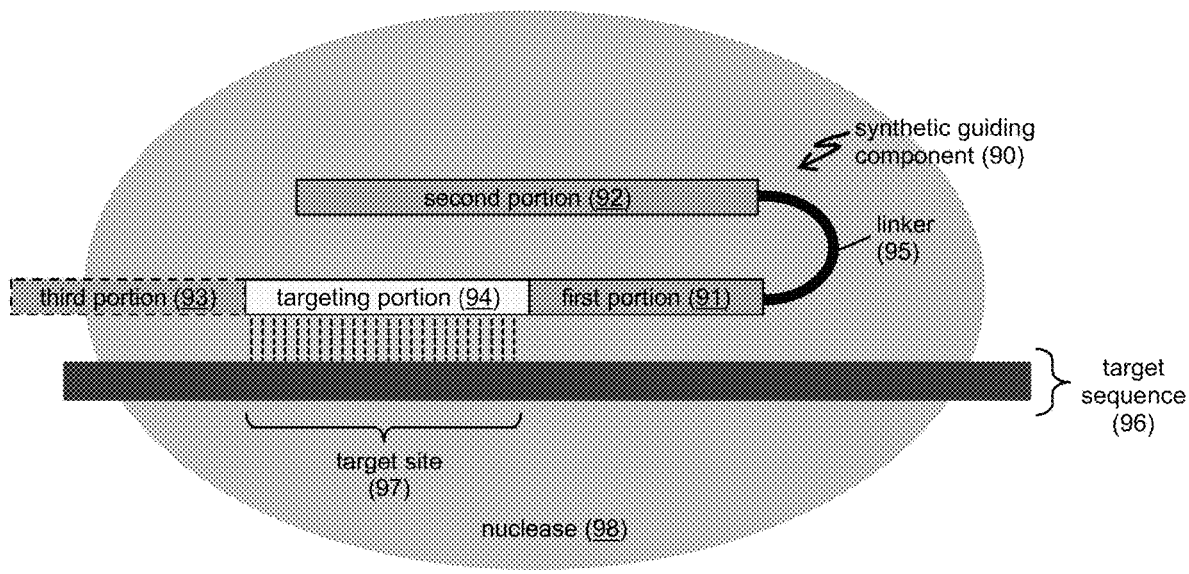
FIG. 1A-1B shows exemplary CRISPR-CAS based systems for targeting a target sequence. Provided are a schematic of an exemplary complex including a synthetic guiding component 90 and a nuclease 98, in which the complex in turn is bound to the target site 97 of the target sequence 96 (FIG. 1A); and a schematic of another exemplary complex including a synthetic guiding component and a Cas enzyme, in which the complex in turn is bound to a single-stranded (ss) target sequence (FIG. 1B).

FIG. 1A provides an exemplary synthetic guiding component 90, which in turn includes a targeting portion 94, a first portion 91, a second portion 92, an optional third portion 93, and a linker 95. In general, the targeting portion 94 includes a nucleic acid sequence that is sufficiently complementary to a desired target site 97 of the target sequence 96. In this way, the guiding component can be programmed to bind to and interact with certain portions of a target sequence. The first and second portions 91,92 provide interactions sites with the nuclease 98 (e.g., a Cas9 nuclease), thereby providing the nuclease in proximity to the target site; and the linker 95 joins the first and second portions.

For a CRISPR-Cas based system, the first portion is typically derived from a crRNA (CRISPR RNA) sequence, and the second portion is typically derived from a tracrRNA (trans-activating crRNA) sequence. Such crRNA and tracrRNA sequences can be truncated or shortened as compared to wild-type sequences identified in bacteria and archaea, and then the truncated sequences can then be joined by way of a linker to form a synthetic guiding component. The linker can be a bond, an organic linker (e.g., an alkylene or heteroalkylene linker), or a nucleic acid sequence (e.g., any described herein). Exemplary sequences for first portions, second portions, and linkers are described herein.

Notably, the present invention relates, in part, to synthetic guiding components that lack a PAMmer sequence. While such a PAMmer sequence may be required for cleavage of DNA, we have identified conditions in which PAMmer sequences are not required for cleavage of RNA. Thus, in some non-limiting instances, the synthetic guiding components lack a PAMmer sequence.

In addition, we also describe conditions in which cleavage efficiency is impaired by duplex regions in the target RNA and in which cleavage efficiency is improved by the presence of mismatched segments that presents a more accessible substrate to ribonucleoprotein complex (e.g., a Cas9-synthetic guiding component complex). Thus, in some non-limiting instances, the guiding component includes one or more modifications that provides target-specificity while reducing substrate-RNP stability. Such modifications can include, e.g., one or more nucleic acid modifications in proximity to the targeting portion of the synthetic guiding component (e.g., one or more nucleic acid modifications in the third portion 93 of the guiding component, such as the 3' end of the third portion; and/or one or more nucleic acid modifications in the first portion 91 of the guiding component, such as the 5' end of the first portion).

Exemplary modifications include one or more modified nucleic acid to promote Cas9 access to the targeting site; or the presence of one or more bulges upon binding of the synthetic guiding component to the target site and/or the target sequence, such as by including one or more unpaired nucleotides in the first portion and/or third portion of the synthetic guiding component when the component is bound to the target sequence. Non-limiting modified nucleic acids include one or more backbone modifications (e.g., modifications to the 2' position of a nucleic acid, such as any described herein), use of bicyclic sugar analogs, one or more phosphate group modifications, one or more internucleoside linkage modifications (e.g., use of flexible alkane, glycol, or ether linkages between residues), and/or one or more sugar modifications (e.g., unlocked forms, such as GNA, TNA, PNA, etc.).

Figure 1B:
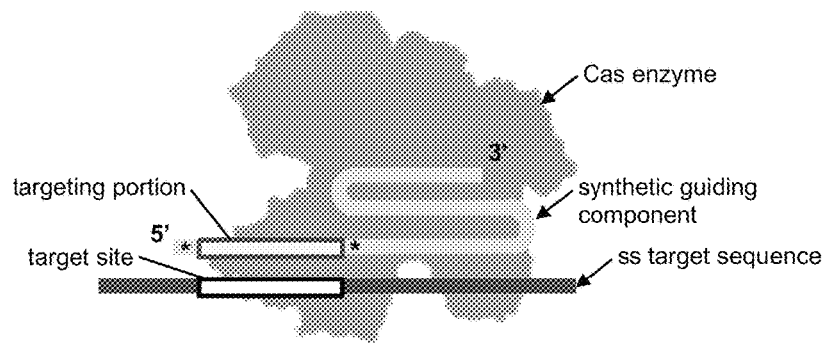

FIG. 1B provides another exemplary synthetic guiding component bound to a Cas enzyme. As can be seen, the targeting portion binds to the target site of the single-stranded (ss) target sequence. Various portions of the synthetic guiding component can have one or more modified nucleic acids. In one non-limiting instance, one or more modified nucleic acids are present in proximity to the 5'-end of the targeting portion and/or the 3'-end of the targeting portion (indicated by asterisks in FIG. 1B). In another non-limiting instance, one or more bulges are present in proximity to the 5'-end of the targeting portion and/or the 3'-end of the targeting portion (indicated by asterisks in FIG. 1B).

Synthetic Guiding Component

The synthetic guiding component can be a single-guide sequence. In particular embodiments, the sequence of the component can be encoded as a vector suitable for in vivo or in vitro expression.

Figure 2A:
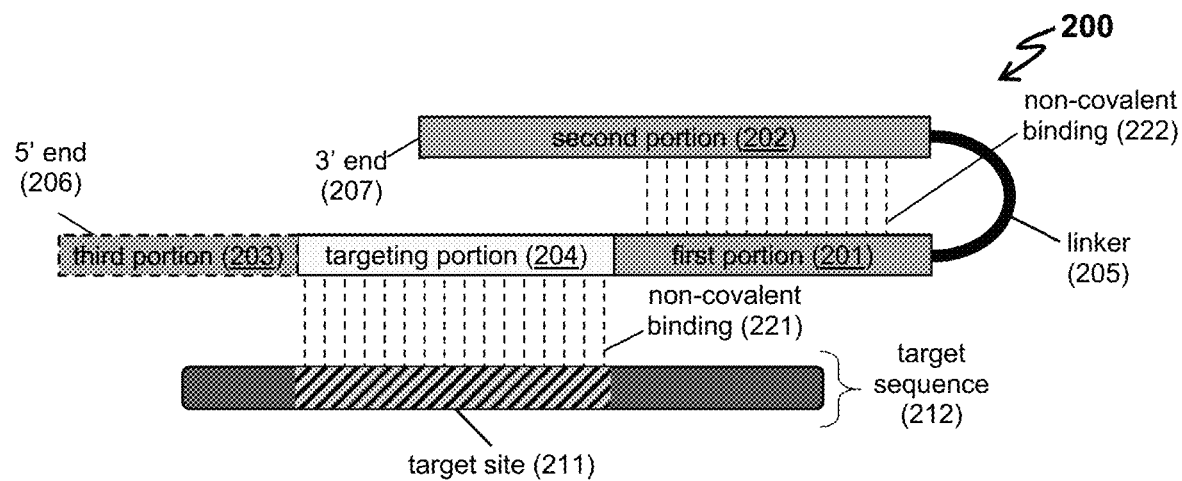
FIG. 2A-2C shows exemplary synthetic guiding components. Provided are a schematic of non-limiting interactions between the targeting portion 204 of the synthetic guiding component 200 with the target site 211 of the target sequence 21, as well as interactions between the first portion 201 and second portion 202 of the component 200 (FIG. 2A); a schematic of a non-limiting synthetic guiding component 300 having a targeting portion 304, a first portion 301, a second portion 302, an optional third portion 303, and a linker 305 disposed between the first and second portions (FIG. 2B); and a schematic of a non-limiting synthetic guiding component 350 having a targeting portion 354, a first portion 351, a second portion 352 having a hairpin, an optional third portion 353, and a linker 355 disposed between the first and second portions (FIG. 2C).
Figure 2B:
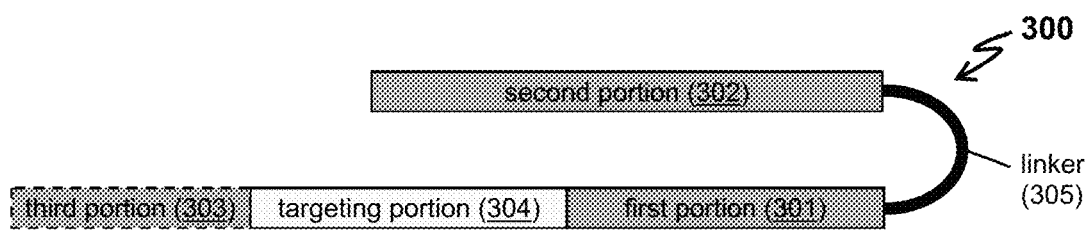
Figure 2C:
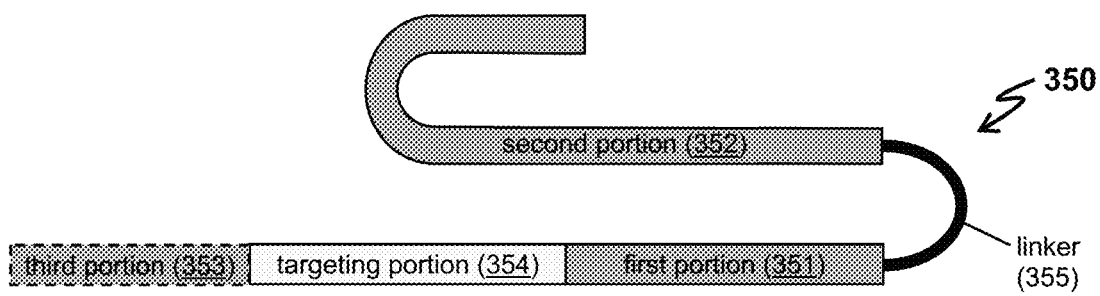
Figure 3A:
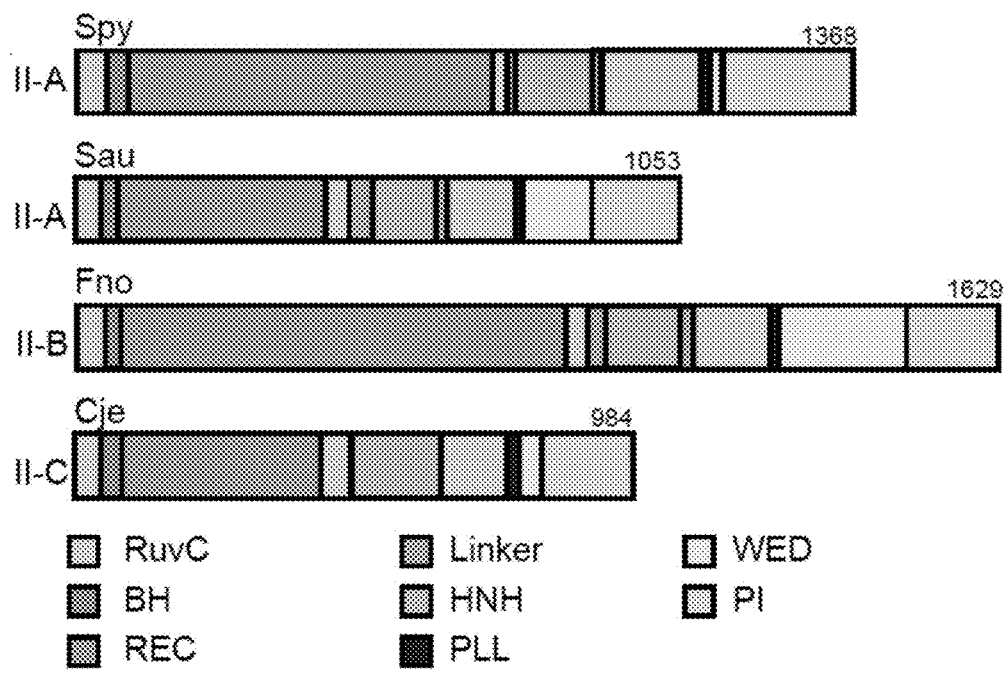
FIG. 3A-3D shows that *Staphylococcus aureus* Cas9 (SauCas9) cleaves single-stranded RNA (ssRNA) without a short DNA oligo containing the PAM sequence (PAMmer). Schematic of Cas9 proteins tested for single-guide RNA (sgRNA) mediated RNA cleavage, which shows the following: RuvC nuclease domain (RuvC), bridge-helix (BH), recognition domain (REC), HNH nuclease domain (HNH), phosphate-lock loop (PLL), wedge domain (WED), and PAM-interacting domain (PI) (FIG. 3A). Adapted from Nishimasu H et al., *Cell* 2015; 162(5):1113-26; Nishimasu H et al., *Cell* 2014; 156(5):935-49; Hirano H et al., *Cell* 2016; 164(5):950-61; and Yamada M et al., *Mol. Cell.* 2017; 65(6):1109-21. Representative in vitro cleavage of ssRNA (FIG. 3B) by Cas9-sgRNA ribonucleoprotein (RNP) complexes of homologs in FIG. 3A. Radiolabeled pUC target RNA was incubated with Cas9 RNP at 37° C. and time points were taken at 0, 10, 30, and 60 min. Full time course is presented in FIG. 4B. T1 indicates size markers generated by RNase T1 digestion of ssRNA target. Size in nucleotides is indicated on the left. In vitro cleavage assay of various RNA substrates (FIG. 3C). Full time course is presented in FIG. 6A, 6D. Schematic of the Cas9-sgRNA RNP complex and various RNA substrates (FIG. 3D).
Figure 3B:
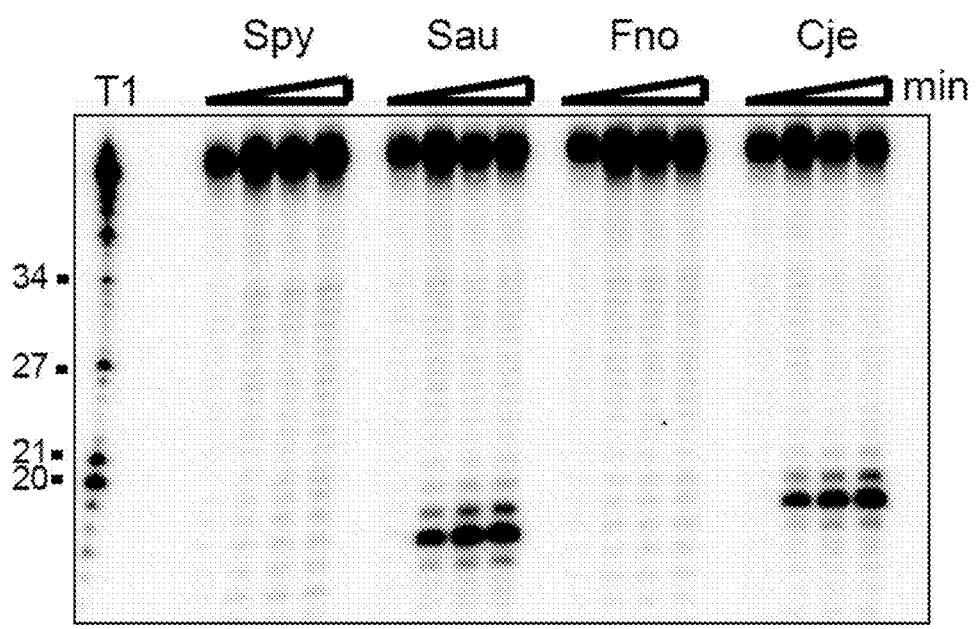
Figure 3C:
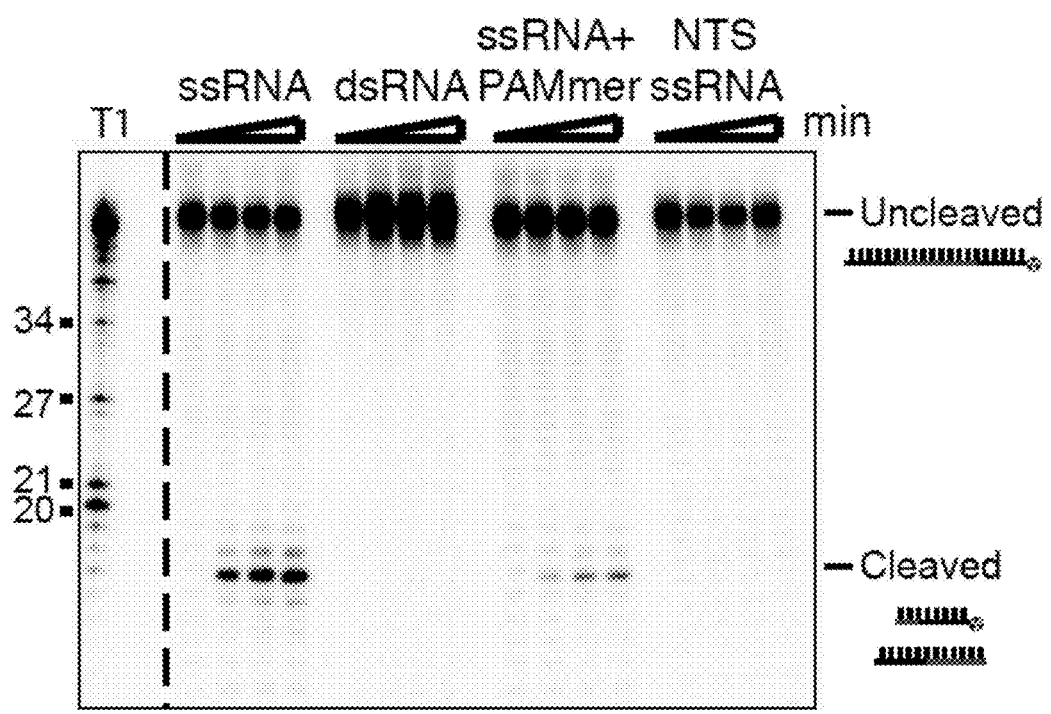
Figure 3D:
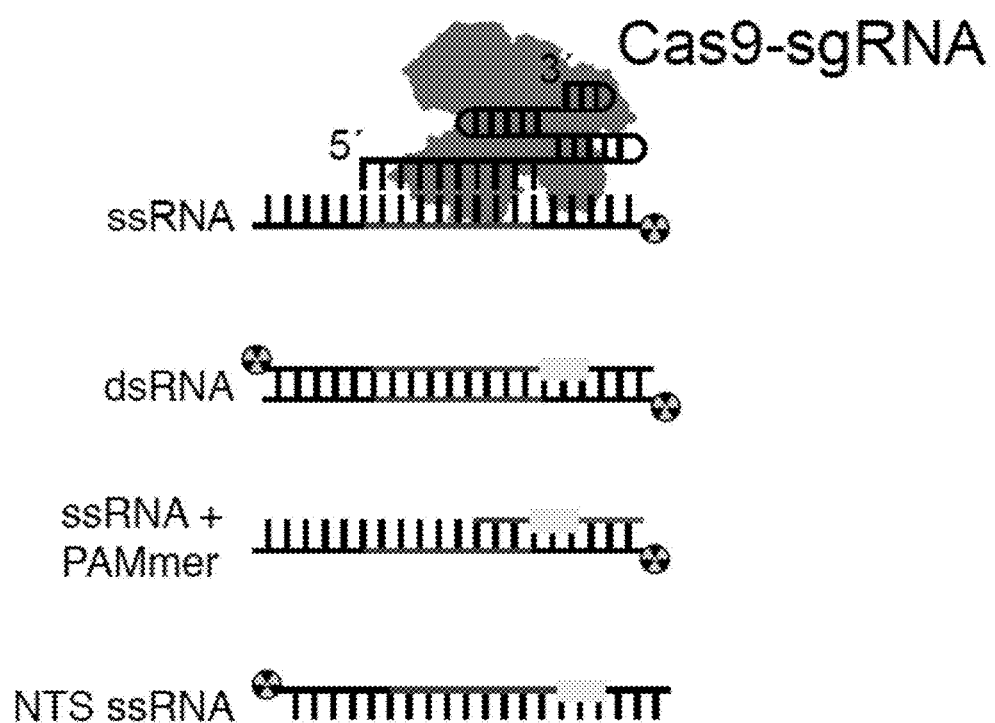
Figure 4A:
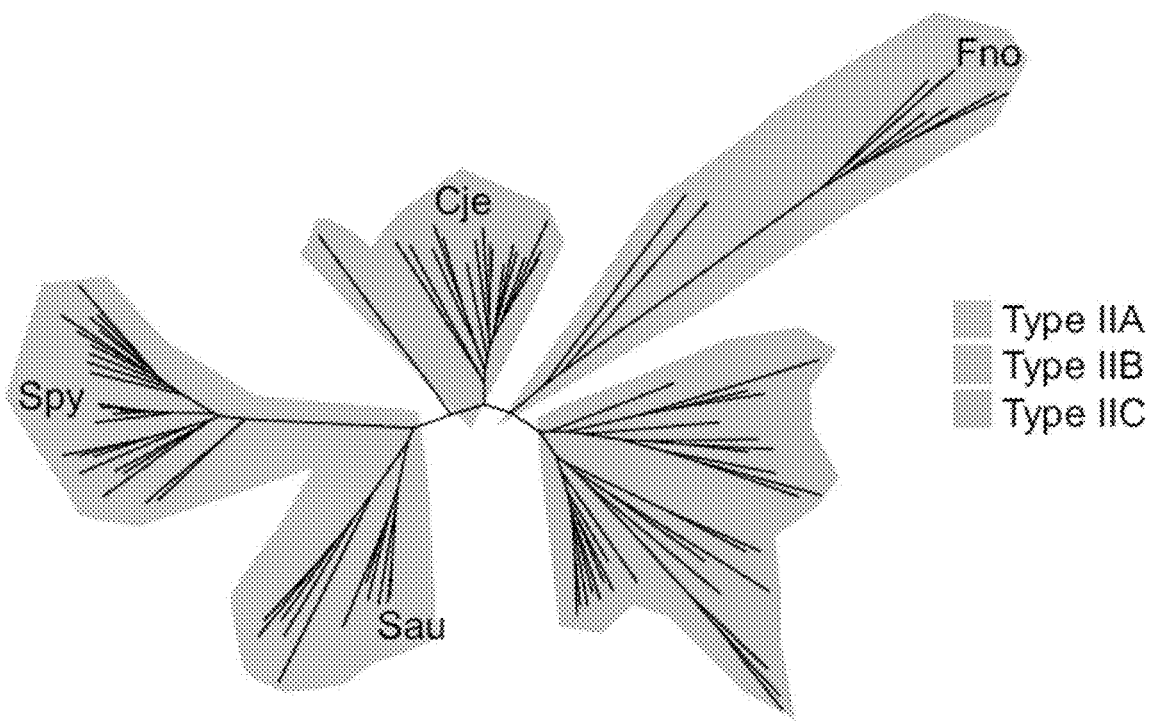
FIG. 4A-4D shows that RNA is cleaved by SauCas9 and CjeCas9. Phylogenetic tree of Cas9 homologs assayed for ssRNA cleavage activity (FIG. 4A). Tree was generated using homologs gathered from Chylinski K et al., *Nucleic Acids Res.* 2014; 42(10):6091-105. Only homologs tested for activity are highlighted as leaves on the tree, and clades are colored by Cas9 sub-type. Representative in vitro cleavage gel (FIG. 4B) for ssRNA targeting by various Cas9 homologs in FIG. 4A. Target used for cleavage was the pUC ssRNA. Time points are 0, 1, 2, 5, 10, 30, 60, and 120 mins. T1 RNase digest size fragments are given on the left. Quantification of fraction (FIG. 4C) cleaved in FIG. 4B. Fit was determined in Prism using a single-exponential decay model. Error bars represent the mean±S.D. (n=3). Apparent pseudo-first order fit parameters (FIG. 4D) of the data in FIG. 4C, where "% cleaved" indicates the fraction of substrate cleaved when the reaction plateaus (mean±S.D.).
Figure 4B:
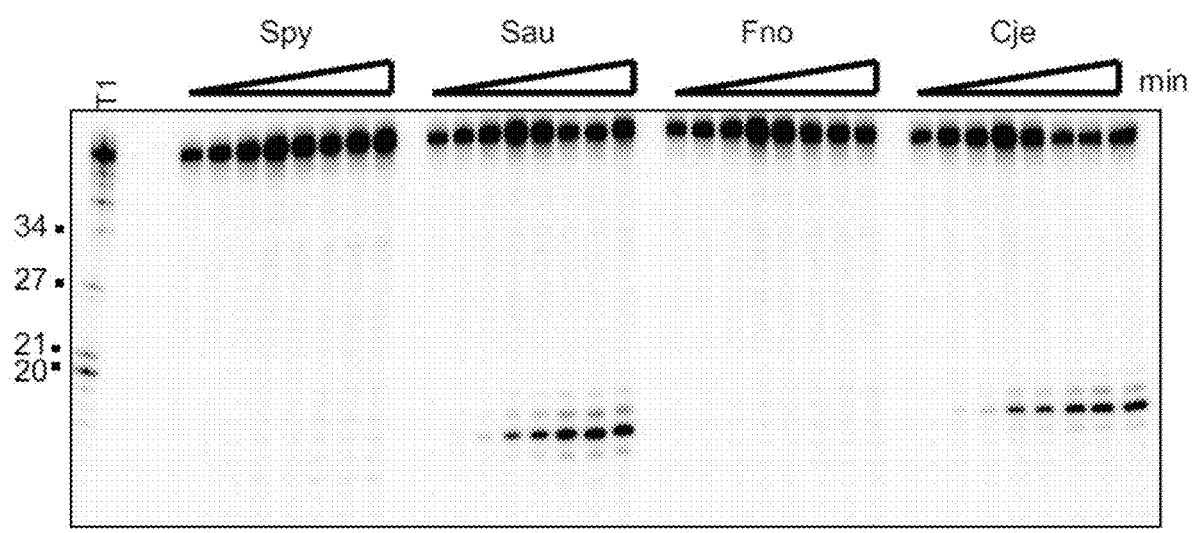
Figures 4C, 4D:
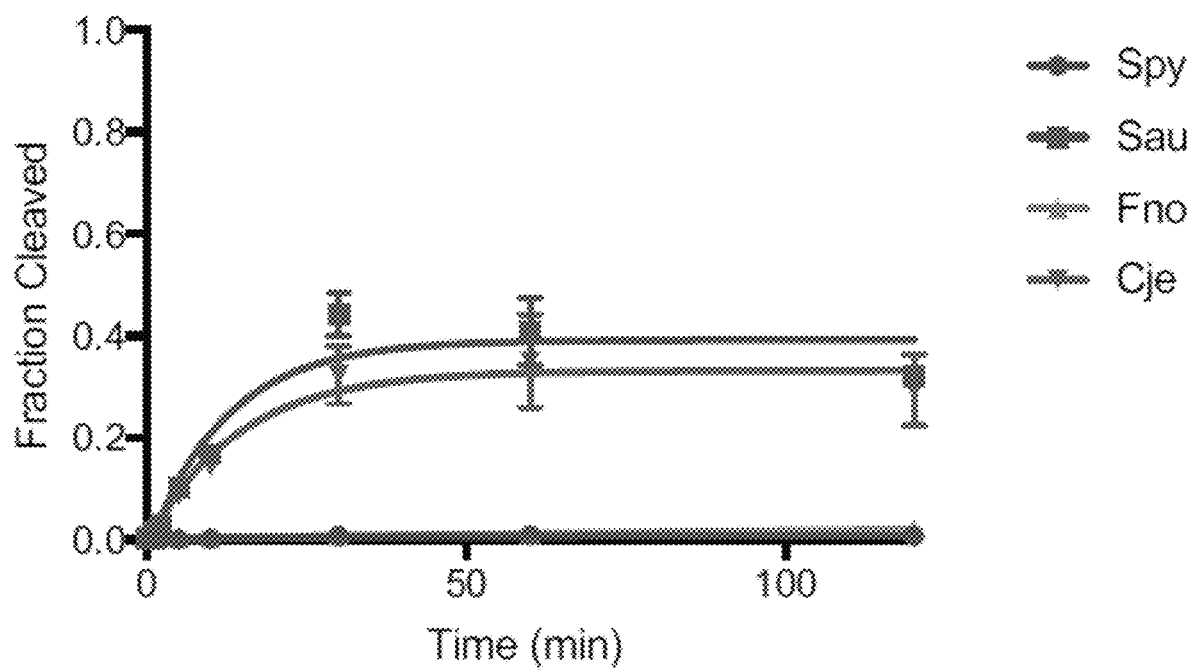

FIG. 2A shows an exemplary synthetic guiding component 200 interacting with the target sequence 212. The synthetic guiding component 200 binds to the target site 211 by way of a targeting portion 204 through non-covalent binding 221. In this manner, the targeting portion confers specificity to the guiding component, thereby allowing certain target sequences to be activated, inactivated, and/or modified.

The synthetic guiding component 200 also includes a first portion 201, a second portion 202, and a linker 205 that covalently links the first and second portions. These portions at the 3' end 207 are configured to recruit the nuclease (e.g., a Cas nuclease) in proximity to the site of the target sequence. Thus, these portions include nucleic acid sequences that provide preferential binding (e.g., specific binding) of the nuclease. Once in proximity, the nuclease can bind and/or cleave the target sequence or a sequence in proximity to the target sequence in a site-specific, programmable manner. In some embodiments, the first and second portions interact by way of non-covalent binding 222, thereby providing secondary structure that beneficially interacts with the nuclease.

The synthetic guiding component 200 can optionally include a third portion 203 at the 5' end 206. The sequence and/or the nucleic acid modifications of the third portion can be optimized to promote binding to the target site or to provide a more accessible substrate to ribonucleoprotein complex.

Figure 20A:
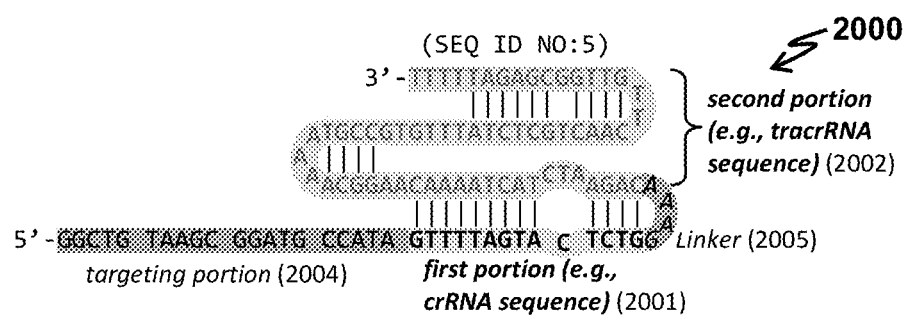
Figure 20B:
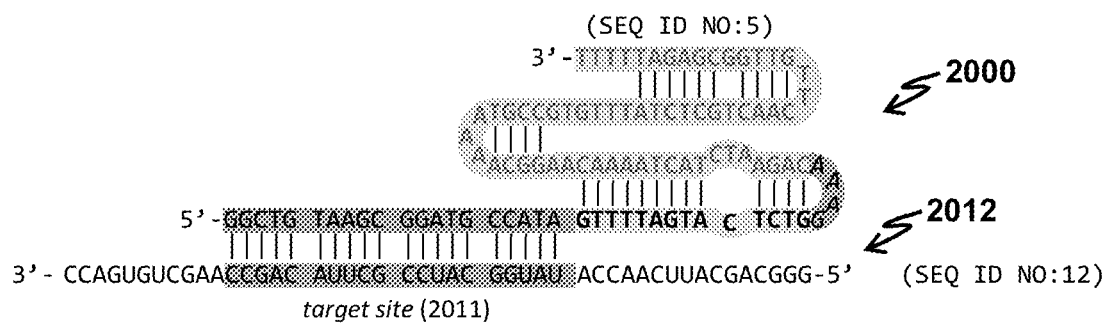

FIG. 20A-20B provides exemplary synthetic guiding components derived from crRNA and tracrRNA sequences. As can be seen, the exemplary synthetic guiding component 2000 includes a first portion 2001 (e.g., a crRNA sequence), a second portion 2002 (e.g., a tracrRNA sequence), a linker 2005 that covalently links the first and second portions, and a targeting portion 2004. Upon binding, the synthetic guiding component 2000 interacts with the target site 2011 of the target sequence 2012.

The first portion, second portion, and linker can be derived in any useful manner. In one instance, the first portion can include a crRNA sequence, a consensus sequence derived from known crRNA sequences, a modified crRNA sequence, or an entirely synthetic sequence known to bind a Cas nuclease or determined to competitively bind a Cas nuclease when compared to a known crRNA sequence. Exemplary sequences for a first portion are described in FIG. 20C-20J (SEQ ID NOs:150-155, 179-186, 213-225, 239-243, 251-253, 256, 257, 260, and 262-264). In some embodiments, the first portion is a crRNA sequence that exhibits at least 50%, 60%, 70%, 80%, 90%, 95%, or 99% of sequence complementarity to any one of SEQ ID NOs: 150-155, 179-186, 213-225, 239-243, 251-253, 256, 257, 260, and 262-264. In other embodiments, the first portion is a fragment (e.g., having a length of about 4, 5, 6, 7, 8, 9, 10, 11, 12, 13, 14, 15, 16, 17, 18, 19, 20, 22, 24, 26, 28, 30, 32, 34, 36, 38, 40, or more nucleotides) of a crRNA sequence that exhibits at least 50%, 60%, 70%, 80%, 90%, 95%, or 99% of sequence complementarity to any one of SEQ ID NOs:150-155, 179-186, 213-225, 239-243, 251-253, 256, 257, 260, and 262-264.

In another instance, the second portion can include a tracrRNA sequence, a consensus sequence derived from known tracrRNA sequences, a modified tracrRNA sequence, or an entirely synthetic sequence known to bind a Cas nuclease or determined to competitively bind a Cas nuclease when compared to a known tracrRNA sequence. Exemplary sequences for a second portion are described in FIG. 20C-20J (SEQ ID NOs:162-178, 192-212, 232-238, 244-250, 254, 255, 258, 259, 261, and 270-273). In some embodiments, the second portion is a tracrRNA sequence that exhibits at least 50%, 60%, 70%, 80%, 90%, 95%, or 99% of sequence complementarity to any one of SEQ ID NOs: 162-178, 192-212, 232-238, 244-250, 254, 255, 258, 259, 261, and 270-273. In other embodiments, the second portion is a fragment (e.g., having a length of about 4, 5, 6, 7, 8, 9, 10, 11, 12, 13, 14, 15, 16, 17, 18, 19, 20, 22, 24, 26, 28, 30, 32, 34, 36, 38, 40, or more nucleotides) of a tracrRNA sequence that exhibits at least 50%, 60%, 70%, 80%, 90%, 95%, or 99% of sequence complementarity to any one of SEQ ID NOs:162-178, 192-212, 232-238, 244-250, 254, 255, 258, 259, 261, and 270-273.

The linker can be any useful linker (e.g., including one or more transcribable elements, such as a nucleotide or a nucleic acid, or including one or more chemical linkers). Further, the linker can be derived from a fragment of any useful tracrRNA sequence (e.g., any described herein). The first and second portions can interact in any useful manner. For example, the first portion can have a sequence portion that is sufficiently complementary to a sequence portion of the second portion, thereby facilitating duplex formation or non-covalent bonding between the first and second portion. In another example, the second portion can include a first sequence portion that is sufficiently complementary to a second sequence portion, thereby facilitating hairpin formation within the second portion. Exemplary sequences for a linker are described in FIG. 20C-20J (SEQ ID NOs:156-161, 187-191, 226-231, and 265-269). In some embodiments, the linker is a sequence that exhibits at least 50%, 60%, 70%, 80%, 90%, 95%, or 99% of sequence complementarity to any one of SEQ ID NOs:156-161, 187-191, 226-231, and 265-269.

In another embodiment, the guiding component has a structure of W—X—Y-L-Z, in which W includes a third portion (e.g., any third portions described herein), X includes a targeting portion, Y includes a first portion (e.g., any first portions or crRNA sequences described herein), L is a linker (e.g., a covalent bond, a nucleic acid sequence, or any other useful linker), and Z is a second portion (e.g., any second portions or tracrRNA sequences described herein). In yet another embodiment, the synthetic guiding component is a sequence that exhibits at least 50%, 60%, 70%, 80%, 90%, 95%, or 99% of sequence complementarity to any one SEQ ID NOs:274-293, or a fragment thereof (FIG. 21).

In addition, the CRISPR components can be formed from any useful combination of one or more nucleic acids (or a polymer of nucleic acids, such as a polynucleotide). Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids, chimeras, or modified forms thereof. Exemplary modifications include any useful modification, such as to the sugar, the nucleobase, or the internucleoside linkage (e.g., to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof. Additional modifications are described herein.

Further exemplary synthetic guiding components and portions thereof (e.g., first portions, second portions, third portions, targeting portions, and linkers) are provided in FIGS. 18A-18E, 20A-20J, and 21. Such components and portions also include fragments of any sequence described therein, as well as substantially identical sequences of any described herein.

Nuclease

The nuclease may be a Cas9 homolog or ortholog. In some embodiments, the nuclease is codon-optimized for expression in a eukaryotic cell. In some embodiments, the nuclease directs cleavage of one or two strands at the location of the target sequence.

Any useful Cas protein or complex can be employed that binds to and/or cleaves a single-stranded sequence (e.g., a ss RNA sequence). Exemplary Cas proteins or complexes include those involved in Type I, Type II, or Type III CRISPR/Cas systems, including but not limited to the CRISPR-associated complex for antiviral defense (Cascade, including a RAMP protein), Cas3 and/or Cas 7 (e.g., for Type I systems, such as Type I-E systems), Cas9 (formerly known as Csn1 or Csx12, e.g., such as in Type II systems), Csm (e.g., in Type III-A systems), Cmr (e.g., in Type III-B systems), Cas10 (e.g., in Type III systems), as well as subassemblies or sub-components thereof and assemblies including such Cas proteins or complexes. Additional Cas proteins and complexes are described in Makarova K S et al., "Evolution and classification of the CRISPR-Cas systems," Nat. Rev. Microbiol. 2011; 9:467-77, which is incorporated herein by reference in its entirety. Non-limiting examples of Cas proteins include Cas1, Cas1B, Cas2, Cas3, Cas4, Cas5, Cash, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof.

In some instances, the nuclease can include one or more mutations, with respect to a corresponding wild-type enzyme, such that the mutated CRISPR enzyme lacks the ability to cleave one or both strands of a target polynucleotide containing a target sequence (e.g., including one or more mutations, such as D10A, N580A, H840A, N854A, and/or N863A in SEQ ID NO:101 or in an amino acid sequence sufficiently aligned with SEQ ID NO:101). Other examples of mutations that render Cas9 a nickase include, without limitation, H840A, N854A, and N863A. In aspects of the invention, nickases may be used for genome editing via homologous recombination. The nuclease can include a nuclear localization sequence (NLS).

Further exemplary nucleases are provided in FIGS. 17A-17E and 19A-19L. Such nucleases also include fragments of any sequence described therein, as well as substantially identical sequences of any described herein.

Complex

A synthetic guiding component and a nuclease can form a complex (i.e., bind via non-covalent interactions). The synthetic guiding component provides target specificity to the complex by comprising a nucleotide sequence that is complementary to a sequence of a target sequence. The nuclease of the complex provides the site-specific activity. In other words, the nuclease is guided to a target sequence (e.g., a target sequence in a chromosomal nucleic acid; a target sequence in a messenger ribonucleic acid; a target sequence in an extrachromosomal nucleic acid, e.g., an episomal nucleic acid, a minicircle, etc.; a target sequence in a mitochondrial nucleic acid; a target sequence in a chloroplast nucleic acid; a target sequence in a plasmid; etc.) by virtue of its association with the protein-binding segment (e.g., the first and/or second portions) of the guiding component.

Such a complex can be assembled prior to administration to a subject (e.g., a host, a human, a mammal, a pathogen, a plant, etc.). Alternatively, the complex can be transcribed within the subject (e.g., by use of one or more vectors configured to encode the complex, the synthetic guiding component, and/or the nuclease), and administration can include delivering the platform that facilitates such transcription.

Target Sequences

The synthetic guiding component can be employed to target any useful nucleic acid sequence (e.g., present in the host's genomic sequence, host's non-coding sequence, and/or the pathogen's genomic sequence). In one instance, the target sequence can include a sequence present in the host's genomic or non-coding sequence in order, e.g., to activate, inactive, or modify expression of a target (e.g., a protein). In another instance, the target sequence can bind to one or more regulator proteins and enhance their transcription and expression. In yet another instance, one or more polypeptides may be up-regulated, as compared to the normal basal rate. Accordingly, the target sequence can be employed to bind to one or more up-regulated polypeptides in order to inactivate or repress transcription/expression of those polypeptides.

In yet another instance, the target sequence can be employed to activate, inhibit, and/or modify a target sequence (e.g., associated with the presence of a pathogen, etc.). For instance, the target sequence can be configured to activate one or more target sequences encoding proteins that promote programmed cell death or apoptosis (e.g., of the pathogen or of particular tissue types, etc.). For instance, the target sequence can be configured to inactivate or modify one or more target sequences encoding proteins that are suppressed by the pathogen. Exemplary target sequence (e.g., in a pathogen) includes, without limitation, a nucleic acid sequence encoding a virulence factor (e.g., a lipase, a protease, a nuclease (e.g., a DNAse or an RNase), a hemolysin, a hyaluronidase, an immunoglobulin protease, an endotoxin, or an exotoxin), a cell surface protein (e.g., an adhesion), an envelope protein (e.g., a phospholipid, a lipopolysaccharide, a lipoprotein, or a polysaccharide), a glycoprotein, a polysaccharide protein, a transmembrane protein (e.g., an invasin), or a regulatory protein.

The synthetic guiding component can be employed to activate the target sequence (e.g., the Cas polypeptide can include one or more transcriptional activation domains, which upon binding of the Cas polypeptide to the target sequence, results in enhanced transcription and/or expression of the target sequence), inactivate the target sequence (e.g., the Cas polypeptide can bind to the target sequence, thereby inhibiting expression of one or more proteins encoded by the target sequence; the Cas polypeptide can introduce single-stranded breaks in the target sequence, thereby inactivating the gene; or the Cas polypeptide can include one or more transcriptional repressor domains, which upon binding of the Cas polypeptide to the target sequence, results in reduced transcription and/or expression of the target sequence), and/or modify the target sequence (e.g., the Cas polypeptide can cleave the target sequence of the pathogen and optionally inserts a further nucleic acid sequence).

Methods and Uses

The components and complexes can be employed in any useful manner. The present components and complexes can be adapted to recognize the target and, if desired, cleave the target sequence. Alternatively, the components and complexes can be adapted to recognize the target and, if desired, provide a signal indicating presence of the target (e.g., by cleaving a reporter that provides a detectable signal once the reporter is cleaved).

Yet other uses include methods of treating a patient or a subject in need (e.g., for a particular disease state or infection). Such methods include administration (e.g., prophylactic administration) of an effective amount of a pharmaceutical composition including an effective amount of a component and/or a complex according to the present invention.

The present invention can also include diagnostic methods, which can include administering to a patient in need an effective amount of a population of a diagnostic component and/or complex, whereupon the recognition of the target is evidenced by a reporter component (moiety) that will enable a diagnosis of the existence of a disease state in the patient.

The components and complexes can be designed in any useful manner. In one embodiment, the component is designed to bind to one or more targets (e.g., target sequences) that are diagnostic for a disease state (e.g., an autoimmune disease, a blood disease, a brain and nervous system disease, a cancer, a childbirth-related or a pregnancy-related disease, an endocrine disease, an environmentally-acquired disease, an infection (e.g., a bacterial infection or a viral infection), an inherited disease, an immune system disease, or an organ disease).

In another embodiment, the component is designed to bind to one or more targets (e.g., target sequences) including a single nucleotide polymorphism (SNP), a point mutation (including a combination of point mutations at different locations), a somatic mutation, an aneuploidy, a microsatellite alteration, an epigenetic modification, etc.

The present invention can include detection methods (e.g., in a test sample), which can include designing a targeting portion of a synthetic guiding component, where the targeting portion is configured to bind to the single-stranded target sequence. Such methods can also include use of a label or a reporter, which can provide a detectable signal upon recognition of the target by the component. In one embodiment, the synthetic guiding component including one or more labels (e.g., any described herein). In another embodiment, the synthetic guiding component can be used in conjunction with a reporter (e.g., a reporter including a non-target strand that optionally includes a label or a combination of labels, such as a quencher and a fluorophore), in which recognition of the target results in the reporter emitting a detectable signal (e.g., in which cleavage of the target and/or non-target strand results in a detectable signal). Exemplary non-target strands can include, e.g., a nucleic acid substrate, such as a mismatched nucleic acid (e.g., including a mismatch between the non-target and target stands for contiguous residues over a region of 7, 8, 9, 10, 11, 12, 13, 14, 15, 16, 17, 18, 19, 20, 21, 22, 23, 24, 25, 30, 35, 40, 45, 50, or more nucleotides) or any described herein.

Such detection can be conducted in any useful manner, such as in a cleavage assay, a kit, or in a diagnostic device (e.g., a lateral flow assay, a microfluidic device, a flow strip, wells, tubes, droplets, combinations thereof, etc.) in combination with one or more optional labels. Exemplary labels can include one or more fluorescent labels, quencher labels, colorimetric labels, quantum dots, nanoparticles, microparticles, barcodes, radio labels (e.g., RF labels or barcodes), avidin, biotin, tags (e.g., affinity tags), dyes, an enzyme that can optionally include one or more linking agents and/or one or more dyes, aptamers, as well as combinations thereof etc.

A test sample can include any useful sample, such as a microorganism, a virus, a bacterium, a fungus, a parasite, a helminth, a protozoon, a cell, tissue, a fluid, a swab, a biological sample (e.g., blood, serum, plasma, cerebrospinal fluid, lymph fluid, interstitial fluid, mucus, saliva, sera, spinal fluid, sputum, stool, synovial fluid, urine, a swab from skin or a mucosal membrane, a combination thereof, etc.), a plant, an environmental sample (e.g., surfaces, fluids, air, soil, and/or water), etc. Samples can include one or more biomarkers, such as circulating cells (e.g., circulating tumor cells), cell types (e.g., lymphocytes), cell-free chromatin, cell-free nucleic acid (e.g., cell-free DNA), exosomes, a loss of heterozygosity marker, mutations (e.g., point mutations, aneuploidy, etc.), microRNA (miRNA) signatures, etc. A test sample can include any useful target or pathogen. Exemplary targets and pathogens include a bacterium, such as such as *Bacillus* (e.g., *B. anthracis*), Enterobacteriaceae (e.g., *Salmonella, Escherichia coli, Yersinia pestis, Klebsiella,* and *Shigella*), *Yersinia* (e.g., *Y. pestis* or *Y. enterocolitica*), *Staphylococcus* (e.g., *S. aureus*), *Streptococcus, Gonorrheae, Enterococcus* (e.g., *E. faecalis*), *Listeria* (e.g., L. monocytogenes), Brucella (e.g., B. abortus, B. melitensis, or B. suis), Vibrio (e.g., V. cholerae), Corynebacterium diphtheria, Pseudomonas (e.g., P. pseudomallei or P. aeruginosa), Burkholderia (e.g., B. mallei or B. pseudomallei), Shigella (e.g., S. dysenteriae), Rickettsia (e.g., R. rickettsii, R. prowazekii, or R. typhi), Francisella tularensis, Chlamydia psittaci, Coxiella burnetii, Mycoplasma (e.g., M mycoides), etc.; an allergen, such as mycotoxins, mold spores, or bacterial spores such as Clostridium botulinum and C. perfringens; a toxin, such as ricin, mycotoxin, tetrodotoxin, anthrax toxin, botulinum toxin, staphylococcal entertoxin B, or saxitoxin; a virus (e.g., an RNA virus or a DNA virus, including single-stranded or double-stranded forms thereof), such as Adenoviridae (e.g., adenovirus), Arenaviridae (e.g., Lassa virus or Machupo virus), Bunyaviridae (e.g., Hantavirus, Rift Valley fever virus, or Sin Nombre virus), Caliciviridae (e.g., norovirus), Coronaviridae, Filoviridae (e.g., Ebola virus, Sudan ebolavirus (SUDV), Zaire ebolavirus (EBOV), Bundibugyo virus (BDBV), and Marburg virus (MARV)), Flaviviridae (e.g., dengue virus (DENV), hepatitis C virus (HCV), Japanese encephalitis virus (JEV), St. Louis encephalitis virus (SLEV), West Nile virus (WNV), and yellow fever virus (YFV)), Hepadnaviridae (e.g., hepatitis B virus), Herpesviridae (e.g., herpes simplex viruses), Nairoviridae (e.g., Crimean-Congo hemorrhagic fever orthonairovirus and Crimean-Congo hemorrhagic fever virus), Orthomyxoviridae (e.g., influenza viruses), Papovaviridae (e.g., papilloma viruses), Paramyxoviridae (e.g., respiratory syncytial virus, measles virus, mumps virus, or parainfluenza virus), Parvoviridae, Picornaviridae (e.g., polioviruses), Poxviridae (e.g., variola viruses), Reoviridae (e.g., rotaviruses), Retroviridae (e.g., human T cell lymphotropic viruses (HTLV) and human immunodeficiency viruses (HIV)), Rhabdoviridae (e.g., rabies virus), and Togaviridae (e.g., Chikungunya virus (CHIKV), Eastern equine encephalitis virus (EEEV), encephalitis viruses, Ross River virus (RRV), rubella virus, Sindbis virus (SINV), Venezuelan equine encephalitis virus (VEEV), Western equine encephalitis virus (WEEV), and yellow fever virus)); a protozoon, such as Cryptosporidium parvum, Encephalitozoa, Plasmodium, Toxoplasma gondii, Acanthamoeba, Entamoeba histolytica, Giardia lamblia, Trichomonas vaginalis, Leishmania, or Trypanosoma (e.g., T. brucei and T. cruzi); a helminth, such as cestodes (tapeworms), trematodes (flukes), or nematodes (roundworms, e.g., Ascaris lumbricoides, Trichuris trichiura, Necator americanus, or Ancylostoma duodenale); a parasite (e.g., any protozoa or helminths described herein); a fungus, such as Aspergilli, Candidae, Coccidioides immitis, and Cryptococci; a pathogen; an environmental contaminant; a water additive; an agricultural marker; a nucleic acid (e.g., oligonucleotides, polynucleotides, nucleotides, nucleosides, molecules of DNA, or molecules of RNA, including a chromosome, a plasmid, a viral genome, a primer, or a gene of any useful pathogen, such as those described herein); or a genetic modification (e.g., antibiotic resistance marker gene). Targets also include food-borne pathogens, such as Salmonella (e.g., Salmonella Typhimurium), pathogenic E. coli (e.g., O157:H7), Bacillus (e.g., B. cereus), Clostridium botulinum, Listeria monocytogenes, Yersinia (e.g., Y. enterocolitica), Norovirus (e.g., Norwalk virus), Shigella, Staphylococcus aureus, Toxoplasma gondii, Vibrio (e.g., V. vulnificus, V. cholera, V. parahaemolyticus), Campylobacter jejuni, and Clostridium perfringens; and weaponized pathogens, such as Bacillus anthracis, Yersinia pestis, Francisella tularensis, Brucella (e.g., B. suis), Burkholderia mallei, Burkholderia pseudomallei, Shigella, Clostridium botulinum, Variola (e.g., V. major), Filoviridae (e.g., Ebola virus and Marburg virus), Arenaviridae (e.g., Lassa virus and Machupo virus), Clostridium perfringens, any food-borne pathogen (e.g., Salmonella species, Escherichia coli O157: H7, or Shigella), Chlamydia psittaci, Coxiella burnetii, Staphylococcal aureus, Rickettsia (e.g., R. prowazekii or R. rickettsii), Alphavirus (e.g., Venezuelan equine encephalitis virus, eastern equine encephalitis virus, or western equine encephalitis virus), Vibrio cholerae, Cryptosporidium parvum, Henipavirus (e.g., Nipah virus), Bunyaviridae (e.g., Hantavirus or Rift Valley fever virus), Flaviviridae (e.g., Japanese encephalitis virus and Yellow fever virus), and Coccidioides spp.

In some embodiments, the sample or target includes an RNA virus (e.g., including a portion thereof). Exemplary, non-limiting RNA viruses include Arenaviridae (e.g., Guanarito virus, Junin virus, Lassa virus, Lujo virus, lymphocytic choriomeningitis virus, Machupo virus, Sabia virus, and Whitewater Arroyo virus), Arteriviridae (e.g., arterivirus and equine arteritis virus), Aspiviridae (e.g., citrus psorosis ophiovirus), Astroviridae (e.g., astrovirus), Bornaviridae (e.g., Borna disease virus), Bunyaviridae (e.g., California encephalitis virus and hantavirus), Bunyavirales (e.g., Cache Valley virus, California encephalitis virus, Crimean-Congo hemorrhagic fever, Hantaan virus, La Crosse encephalitis virus, Jamestown Canyon virus, Rift Valley fever virus, and Snowshoe hare virus), Caliciviridae (e.g., Norwalk virus), Coronaviridae (e.g., corona virus), Filoviridae (e.g., Ebola virus, Marburg virus, and Sudan virus), Fimoviridae, Flaviviridae (e.g., dengue virus, hepatitis C virus, Japanese encephalitis virus, St. Louis encephalitis virus, Usutu virus, West Nile virus, yellow fever virus, and Zika virus), Hepeviridae (e.g., hepatitis E virus), Jonviridae, Metaviridae, Nyamiviridae, Orthomyxoviridae (e.g., influenza virus A, influenza virus B, influenza virus C, influenza virus D, isavirus, quaranjavirus, and thogotovirus), Orthohantavirus (e.g., Sin Nombre virus), Orthonairovirus (e.g., Crimean-Congo hemorrhagic fever orthonairovirus, Dugbe virus, Kasokero virus, and Nairobi sheep disease virus), Orthotospovirus, Paramyxoviridae (e.g., avian paramyxovirus, canine distemper virus measles virus, Hendra virus, human parainfluenza viruses, mumps virus, Nipah virus, respiratory syncytial virus, Rinderpest virus, and Sendai virus), Peribunyaviridae, Phasmaviridae, Phenuiviridae (e.g., Rift Valley fever phlebovirus), Picornaviridae (e.g., aphthovirus, cardiovirus, coxsackie virus, enterovirus, erbovirus, hepatovirus, kobuvirus, parechovirus, poliovirus, rhinovirus, and teschovirus), Pseudoviridae, Reoviridae (e.g., Banna virus, cypovirus, reovirus, and rotavirus), Retroviridae (e.g., human immunodeficiency virus (HIV), hepatitis B virus, and cauliflower mosaic virus), Rhabdoviridae (e.g., rabies virus and vesicular stomatitis virus), and Togaviridae (e.g., alphavirus, Chikungunya virus, Eastern equine encephalitis virus, rubella virus, O'Nyong-nyong fever virus, Ross River fever virus, Semliki Forest virus, Sindbis fever virus, Venezuelan equine encephalitis virus, and Western equine encephalitis virus).

EXAMPLES

Example 1: RNA-Dependent RNA Targeting by CRISPR-Cas9

Double-stranded DNA (dsDNA) binding and cleavage by Cas9 is a hallmark of type II CRISPR-Cas bacterial adaptive immunity. All known Cas9 enzymes are thought to recognize DNA exclusively as a natural substrate, providing protection against DNA phage and plasmids. Here, we show that Cas9 enzymes from both subtypes II-A and II-C can recognize and cleave single-stranded RNA (ssRNA) by an RNA-guided mechanism that is independent of a protospacer-adjacent motif (PAM) sequence in the target RNA. RNA-guided RNA cleavage was programmable and site-specific, and we find that this activity can be exploited to reduce infection by single-stranded RNA phage in vivo. We also demonstrate that Cas9 can direct PAM-independent repression of protein synthesis in bacteria. These results indicate that a subset of Cas9 enzymes has the ability to act on both DNA and RNA target sequences, and suggest the potential for use in programmable RNA targeting applications.

Prokaryotic clustered regularly interspaced short palindromic repeat (CRISPR) systems provide immunity against plasmids and bacteriophage by using foreign DNA stored as CRISPR spacer sequences together with CRISPR-associated (Cas) nucleases to stop infection (see, e.g., Wright A V et al., "Biology and applications of CRISPR systems: harnessing nature's toolbox for genome engineering," *Cell* 2016; 164 (1-2):29-44; and Mohanraju P et al., "Diverse evolutionary roots and mechanistic variations of the CRISPR-Cas systems," *Science* 2016; 353(6299):aad5147 (14 pp.)). One such nuclease, Cas9 of the type II systems, employs a CRISPR RNA (crRNA) and a trans-activating crRNA (tracrRNA) to target spacer-complementary regions (protospacers) on the foreign genetic element to guide double-stranded DNA cleavage (see, e.g., Jinek M et al., "A programmable dual-RNA-guided DNA endonuclease in adaptive bacterial immunity," *Science* 2012; 337(6096):816-21). A protospacer adjacent motif (PAM) must also be present for the Cas9-RNA complex to bind and cleave DNA (see, e.g., Jinek M et al., *Science* 2012; 337(6096):816-21; Gasiunas G et al., "Cas9-crRNA ribonucleoprotein complex mediates specific DNA cleavage for adaptive immunity in bacteria," *Proc. Nat'l Acad. Sci. USA* 2012; 109(39):E2579-86; Anders C et al., "Structural basis of PAM-dependent target DNA recognition by the Cas9 endonuclease," *Nature* 2014; 513(7519):569-73; and Szczelkun M D et al., "Direct observation of R-loop formation by single RNA-guided Cas9 and Cascade effector complexes," *Proc. Nat'l Acad. Sci. USA* 2014; 111(27):9798-803). Combining the crRNA and tracrRNA into a chimeric, single-guide RNA (sgRNA) simplified the system for widespread adoption as a versatile genome editing technology (see, e.g., Jinek M et al., *Science* 2012; 337(6096):816-21).

To date, both genetic and biochemical data support the conclusion that in vivo, Cas9 is exclusively a DNA-targeting enzyme. Nonetheless, multiple studies have harnessed Cas9 for RNA targeting under specific circumstances. For example, *S. pyogenes* Cas9 (SpyCas9) can be supplied with a short DNA oligo containing the PAM sequence (a PAMmer) to induce single-stranded RNA (ssRNA) binding and cutting (see, e.g., O'Connell M R et al., "Programmable RNA recognition and cleavage by CRISPR/Cas9," *Nature* 2014; 516(7530):263-6; and Nelles D A et al., "Programmable RNA tracking in live cells with CRISPR/Cas9," *Cell* 2016; 165(2):488-96). More recently, it was demonstrated that SpyCas9 could be used to target repetitive RNAs and repress translation in certain mRNAs in the absence of a PAMmer (see, e.g., Liu Y et al., "Targeting cellular mRNAs translation by CRISPR-Cas9," *Sci. Rep.* 2016; 6:29652 (9 pp.); and Batra R et al., "Elimination of toxic microsatellite repeat expansion RNA by RNA-targeting Cas9," *Cell* 2017; 170(5):899-912).

A different Cas9 homolog from *Francisella novicida* (FnoCas9) has been implicated in degradation of a specific mRNA but through a mechanism independent of RNA-based cleavage (see, e.g., Sampson T R et al., "A CRISPR/Cas system mediates bacterial innate immune evasion and virulence," *Nature* 2013; 497(7448):254-7). Together with evidence that some Cas9 homologs can target single-stranded DNA substrates under some conditions (see, e.g., Ma E et al., "Single-stranded DNA cleavage by divergent CRISPR-Cas9 enzymes," Mol. *Cell* 2015 Nov. 5; 60(3):398-407; and Zhang Y et al., "DNase H activity of *Neisseria meningitidis* Cas9," *Mol. Cell.* 2015; 60(2):242-55), these studies raised the possibility that certain Cas9 enzymes might have intrinsic RNA-guided RNA cleavage activity.

To determine whether evolutionarily divergent Cas9 homologs have a native capacity for programmable RNA targeting, we compared biochemical behavior of enzymes from the three major Cas9 subtypes. This analysis revealed that certain type II-A and II-C Cas9s can bind and cleave single-stranded RNA sequences with no requirement for a PAM or PAMmer. Furthermore, we found that this activity can inhibit mRNA translation and protect cells from infection by ssRNA phage by a mechanism reminiscent of RNA-guided DNA targeting. These results establish the utility of Cas9 for facile RNA-guided RNA targeting and suggest that this activity may have biological relevance in bacteria. Additional details follow.

Example 2: Materials and Methods

The following materials and methods were employed for data provided herein. Such materials and methods are exemplary, as would be understood by a skilled artisan.

Phylogenetic tree construction and RNA folding: Cas9 homolog sequences were obtained from Chylinski and colleagues (see, e.g., Chylinski K et al., "Classification and evolution of type II CRISPR-Cas systems," *Nucleic Acids Res.* 2014; 42(10):6091-105). A structure-guided alignment was produced using PROMALS3D (see, e.g., Pei J et al., "PROMALS3D: a tool for multiple protein sequence and structure alignments," *Nucleic Acids Res.* 2008; 36(7):2295-300), and a maximum-likelihood tree was inferred using PHYML3.0 (see, e.g., Guindon S et al., "New algorithms and methods to estimate maximum-likelihood phylogenies: assessing the performance of PhyML 3.0," *Syst. Biol.* 2010; 59(3):307-21). The structure of the pUC ssRNA target was predicted using Mfold (see, e.g., Zuker M, "Mfold web server for nucleic acid folding and hybridization prediction," *Nucleic Acids Res.* 2003; 31(13):3406-15).

Protein purification: All proteins were expressed as His-Maltose-Binding Protein (MBP) fusions (Addgene vector #29706) in *E. coli* strain BL21 (DE3). Cells were grown to an $OD_{600}$ of 0.6-0.8, induced with 0.4 M isopropylthiogalactoside (IPTG), and then incubated overnight at 16° C. with shaking. Proteins were purified using Superflow Ni-NTA affinity resin (Qiagen, Valencia, Calif.), followed by a HiTrap HP Heparin column (GE Healthcare, Pittsburgh, Pa.) and gel filtration on a Superdex S200 (GE Healthcare, Pittsburgh, Pa.), as previously described (see, e.g., Jinek M et al., "A programmable dual-RNA-guided DNA endonuclease in adaptive bacterial immunity," *Science* 2012; 337 (6096):816-21). Cas9 protein sequences can be found in FIG. 17A-17E.

Oligonucleotide purification and radiolabeling: DNA oligonucleotides were synthesized by Integrated DNA Technologies, Inc. (Coralville, Iowa). Target RNAs and sgRNAs were transcribed in vitro as previously described (see, e.g., Sternberg S H et al., "Mechanism of substrate selection by a highly specific CRISPR endoribonuclease," RNA 2012; 18(4):661-72). DNA targets and in vitro transcribed RNAs were gel purified by 7 M urea denaturing PAGE. Target RNAs and DNAs were 5' end-labeled with [γ-P32-ATP] by treatment with PNK (New England Biolabs, Inc., Ipswich, Mass.). T1 sequencing and hydrolysis ladders were prepared according to manufacturer's directions (Ambion, Inc., Grand Island, N.Y.). A list of all sgRNAs and targets can be found in FIG. 18A-18E.

In vitro cleavage assays: Cas9 was reconstituted with equimolar sgRNA in 1× cleavage buffer (20 mM Tris-HCl-pH 7.5, 200 mM KCl, 1 mM tris(2-chloroethyl) phosphate (TCEP), 5% glycerol, 5 mM $MgCl_2$) for 10 min at 37° C., then immediately placed on ice. Cleavage reactions were conducted with 1 nM target and 10 nM reconstituted Cas9-sgRNA in 1× cleavage buffer unless otherwise noted. Structured RNA substrates were prepared by annealing the target strand with 10-fold excess of the non-target strand to ensure that all target is complexed prior to the cleavage reaction. Reactions were incubated at 37° C. for the indicated time and quenched in Heparin-EDTA buffer (10 μg/ml heparin, 25 mM EDTA) at 25° C. for 5 min. Reactions were diluted with 2× formamide loading buffer and incubated at 95° C. for 5 min prior to separation on a 15% denaturing 7 M urea PAGE gel. Gels were dried overnight and exposed to a phosphor imaging screen (Amersham/GE Healthcare, Pittsburgh, Pa.). Results were visualized on a Typhoon (GE Healthcare, Pittsburgh, Pa.) and quantified in ImageQuantTL (v8.1, GE Healthcare, Pittsburgh, Pa.). Cleavage reactions were fit with a one-phase exponential decay model in Prism7 (GraphPad Software, La Jolla, Calif.).

Filter binding and electrophoretic mobility shift assays: Binding reactions consisted of 750 nM catalytically inactive SauCas9 reconstituted with sgRNA to the final concentrations indicated. Radiolabeled target RNA was added to a final concentration of 1 nM and the reactions were incubated at 37° C. for one hour. Bound probe was separated from unbound using a three-filter system on a vacuum manifold (see, e.g., Rio D C, "Filter-binding assay for analysis of RNA-protein interactions," Cold Spring Harb. Protoc. 2012; 2012(10):1078-81). Membranes were allowed to dry prior to phosphor imaging and quantification. EMSAs were performed in the presence of 300 nM dSauCas9 and 1 nM radiolabeled target strand DNA pre-annealed in the presence of 10× non-target strand. Complexes were incubated at 37° C. for one hour prior to separation on 6% non-denaturing PAGE. Gels were dried prior to phosphor imaging. Binding isotherms were determined in Prism using a one-site binding model.

MS2 screen and plaque assay: All guides of length 20-23 nt antisense to the MS2 bacteriophage genome were synthesized (CustomArray Inc., Bothell, Wash.) and cloned into a guide expression vector (see, e.g., Oakes B L et al., "Profiling of engineering hotspots identifies an allosteric CRISPR-Cas9 switch," Nat. Biotechnol. 2016; 34(6):646-51) modified with the SauCas9 sgRNA scaffold. XL1-Blue E. coli cells with a vector containing a tetracycline-inducible wtSauCas9 construct were made electrocompetent and transformed with the MS2-guide plasmid library in triplicate. Approximately $1 \times 10^6$ transformants were grown for 30 min at 37° C. with shaking prior to addition of antibiotics and 10 nM anhydrotetracycline (aTc) (Sigma-Aldrich Corp., St. Louis, Mo.) for protein induction. After an additional 30 min of growth, cultures were split into three equal pools and treated with none, $3.3 \times 10^6$, or $3.3 \times 10^7$ MS2 bacteriophage. After three hours of infection, cells were plated on LB-agar supplemented with antibiotics and incubated at 37° C. for 16 hours. Plates were scraped with LB and plasmids were isolated using a MidiPrep kit (Qiagen, Valencia, Calif.), according to the manufacturer's protocol.

High-throughput sequencing libraries were prepared by PCR amplification of the variable region of the guide plasmid. Dual unique-molecular identifiers (UMIs), included to separate true single-nucleotide mismatches, as well as duplicates, from PCR artifacts (see, e.g., Kou R et al., "Benefits and challenges with applying unique molecular identifiers in next generation sequencing to detect low frequency mutations," PLoS One 2016; 11(1):e0146638 (15 pp.)), were incorporated during a single round of PCR. Excess UMIs were removed by ExoI digestion (Thermo Scientific, Waltham, Mass.) prior to library amplification and barcoding. Individual guides (FIG. 18C) were cloned using oligonucleotides synthesized by IDT and co-transformed into XL1-Blue E. coli cells with the SauCas9 vector. Resistance to MS2 bacteriophage was conducted using a soft-agar overlay method (see, e.g., Abudayyeh O O et al., "C2c2 is a single-component programmable RNA-guided RNA-targeting CRISPR effector," Science 2016; 353(6299): aaf5573 (9 pp.)), and plaque forming units (PFUs) were calculated. To minimize variability in plaquing efficiency, the same phage dilutions were used for all experiments.

MS2 survival and mismatch analysis: After applying a low-pass filter, reads were trimmed using cutadapt v. 1.14 (see, e.g., Martin M, "Cutadapt removes adapter sequences from high-throughput sequencing reads," EMBnet.journal 2011; 17(1):10-2); and paired-end overlapping reads were merged using pandaseq for error correction (see, e.g., Masella A P et al., "PANDAseq: PAired-eND Assembler for Illumina sequences," BMC Bioinformatics 2012; 13:31 (7 pp.)). Reads were mapped to the MS2 genome with bowtie2 v2.3.0 (see, e.g., Langmead B et al., "Fast gapped-read alignment with Bowtie 2," Nat. Methods 2012; 9(4):357-9) using the "very-sensitive" option and de-duplicated based on the dual-UMI (see, e.g., Smith T et al., "UMI-tools: modeling sequencing errors in Unique Molecular Identifiers to improve quantification accuracy," Genome Res. 2017; 27(3): 491-499). Feature counts were obtained using HTSeq—count (see, e.g., Anders S et al., "HTSeq—a Python framework to work with high-throughput sequencing data," Bioinformatics 2015; 31(2):166-9). Differential expression was calculated using standard pipelines implemented in "edgeR" (see, e.g., Robinson M D et al., "edgeR: a Bioconductor package for differential expression analysis of digital gene expression data," Bioinformatics 2010; 26(1):139-40; and McCarthy D J et al., "Differential expression analysis of multifactor RNA-Seq experiments with respect to biological variation," Nucleic Acids Res. 2012; 40(10):4288-97).

Significantly enriched guides were defined as those with an FDR-corrected p-value <0.05. Guides with a positive fold-change compared to the control were mapped to the MS2 genome and visualized using the "Sushi" package (see, e.g., Phanstiel D H et al., "Sushi®: flexible, quantitative and integrative genomic visualizations for publication-quality multi-panel figures," Bioinformatics 2014; 30(19):2808-10). To examine for nucleotide composition bias, sequences of guides with a significant positive enrichment were aligned at the 3' end (PAM-proximal) and motifs were analyzed using the WebLogo server (see, e.g., Crooks G E et al., "WebLogo: a sequence logo generator," Genome Res. 2004; 14(6):1188-90). The distribution of $log_2$ fold-change values of significantly enriched guides were plotted as box and whisker plots in Prism.

The secondary structure of the MS2 genome was obtained from Dai X et al., "In situ structures of the genome and genome-delivery apparatus in a single-stranded RNA virus," Nature 2017; 541(7635):112-6; and reads were mapped and visualized in Forna (see, e.g., Kerpedjiev P et al., "Forna (force-directed RNA): simple and effective online RNA secondary structure diagrams," Bioinformatics 2015; 31(20):3377-9. $Log_2$ fold-change values of single-nucleotide mismatch (SNP) guides for each treatment were partitioned by length and averaged at each position. Some of the high-throughput sequencing data are available through the Sequencing Read Archive under the BioProject accession number PRJNA413805.

E. coli in vivo GFP repression: Based on the system outlined previously, SauCas9 was cloned into a tetracycline-inducible vector, while individual guides are under control of a constitutive promoter (see, e.g., Oakes B L et al., Nat. Biotechnol. 2016; 34(6):646-51). Plasmids were transformed into an E. coli strain with a GFP reporter gene integrated into the chromosome (see, e.g., Qi L S et al., Cell 2013; 152(5):1173-83). Cultures were grown in M9 medium supplemented with 0.4% w/v glucose to mid-log phase and diluted to an $OD_{600}$ of 0.05 prior to transfer to a Tecan Microplate reader (Tecan Systems, San Jose, Calif.). Protein expression was induced with 10 nM anhydrotetracycline (aTc). GFP and $OD_{600}$ were measured every ten minutes for at least 18 hours. Curves of GFP expression over time were fit with a logistic growth model in Prism. At 80% of the maximum value, or at least after 16 hours of growth, the GFP signal was normalized by cell density at $OD_{600}$.

To account for effects of guide and protein expression, $GFP/OD_{600}$ was normalized to a null guide or null protein culture, respectively. As expression of different guides change GFP expression levels, the ratio between normalized RNP and guide values was taken to allow comparison of RNP-based repression across different guides. All experiments were conducted in triplicate, and all graphing and quantitative analyses were conducted in Prism. Guide and target sequences can be found in FIG. 18D-18E.

Example 3: Cas9 Catalyzes PAM-Independent RNA-Guided RNA Cleavage

To assess whether divergent Cas9 enzymes can catalyze binding to and cleavage of RNA substrates by a mechanism distinct from that of double-stranded DNA cleavage, we tested homologs from the three major subtypes of Cas9 proteins for their ability to cleave single-stranded RNA in vitro (FIG. 3A-3B and FIG. 4A-4D). When programmed with a cognate sgRNA, S. aureus Cas9 (SauCas9) and C. jejuni Cas9 (CjeCas9) directed cleavage of RNA in the absence of a PAMmer (FIG. 3A-3D and FIG. 4B-4D). No RNA cleavage was detected using SpyCas9, which requires a PAMmer for efficient RNA cleavage in vitro (see, e.g., O'Connell M R et al., Nature 2014; 516(7530):263-6), or using F. novicida Cas9 (FnoCas9). While the cleavage efficiencies for both SauCas9 and CjeCas9 were indistinguishable (FIG. 4D), we initially focused on the activity of SauCas9 due to the abundance of mechanistic and structural data for this enzyme (see, e.g., Nishimasu H et al., "Crystal structure of Staphylococcus aureus Cas9," Cell 2015; 162 (5):1113-26; Friedland A E et al., "Characterization of Staphylococcus aureus Cas9: a smaller Cas9 for all-in-one adeno-associated virus delivery and paired nickase applications," Genome Biol. 2015; 16:257 (10 pp.); Ran F A et al., "In vivo genome editing using Staphylococcus aureus Cas9," Nature 2015; 520(7546):186-91; and Kleinstiver B P et al., "Broadening the targeting range of Staphylococcus aureus CRISPR-Cas9 by modifying PAM recognition," Nat. Biotechnol. 2015; 33(12):1293-8).

Figure 5A:
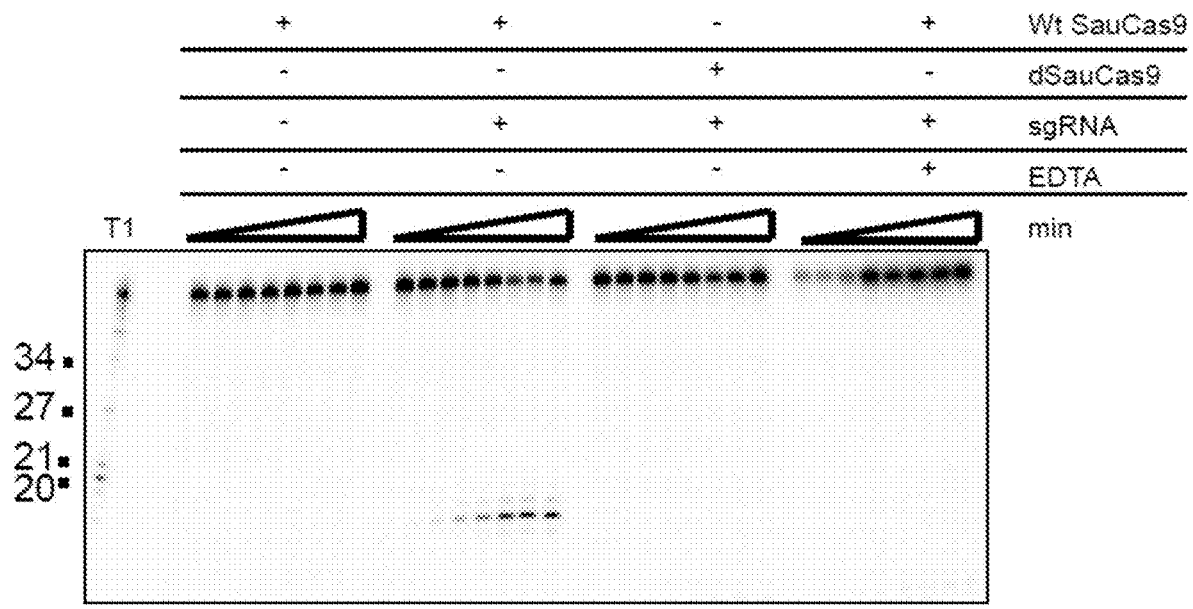
FIG. 5A-5E shows that ssRNA cleavage is similar to canonical dsDNA cleavage by Cas9. In vitro SauCas9 cleavage assay of ssRNA (FIG. 5A). Reactions were incubated with wild-type SauCas9 (Wt SauCas9) or catalytically-inactive SauCas9 (dSauCas9; D10A and N580A) in the presence or absence of sgRNA as indicated above the reactions. EDTA was included at 25 mM where applicable. Under tested conditions, SauCas9 ssRNA cleavage was single-turnover (FIG. 5B). SauCas9 RNP was incubated with the RNA target in the various ratios indicated. Time points are 0, 1, 2, 5, 10, 30, 60, and 120 mins in FIG. 5A-5B. T1 RNase digest size fragments are given on the left. Target used for cleavage was the pUC ssRNA. Graphical representation of ssRNA fraction cleaved (FIG. 5C) of reactions in FIG. 5B. Fit was determined in Prism using a single-exponential decay model. Error bars represent the mean±S.D. (n=3). Mapping of SauCas9 ssRNA cleavage site (FIG. 5D). Reaction products from a 2-hr incubation of SauCas9 RNP with the pUC ssRNA target were separated on a 15% denaturing PAGE gel with a hydrolysis and T1 digest ladder to determine exact site of the major cleavage product. Diagram of canonical DNA cleavage position and ssRNA cleavage position (FIG. 5E) as determined in FIG. 5D for the target (SEQ ID NO:12) in reference to the exemplary sgRNA (SEQ ID NO:303).
Figure 5B:
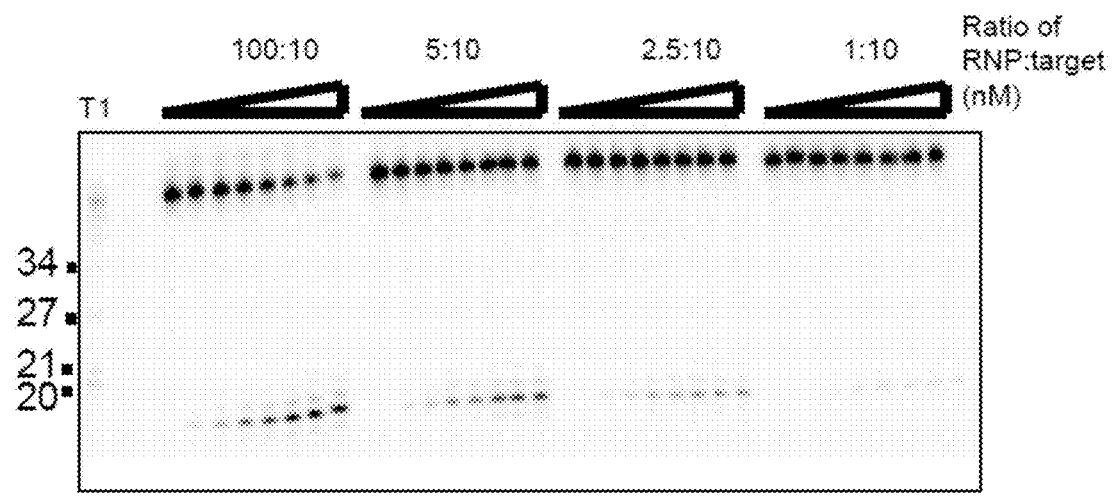
Figure 5C:
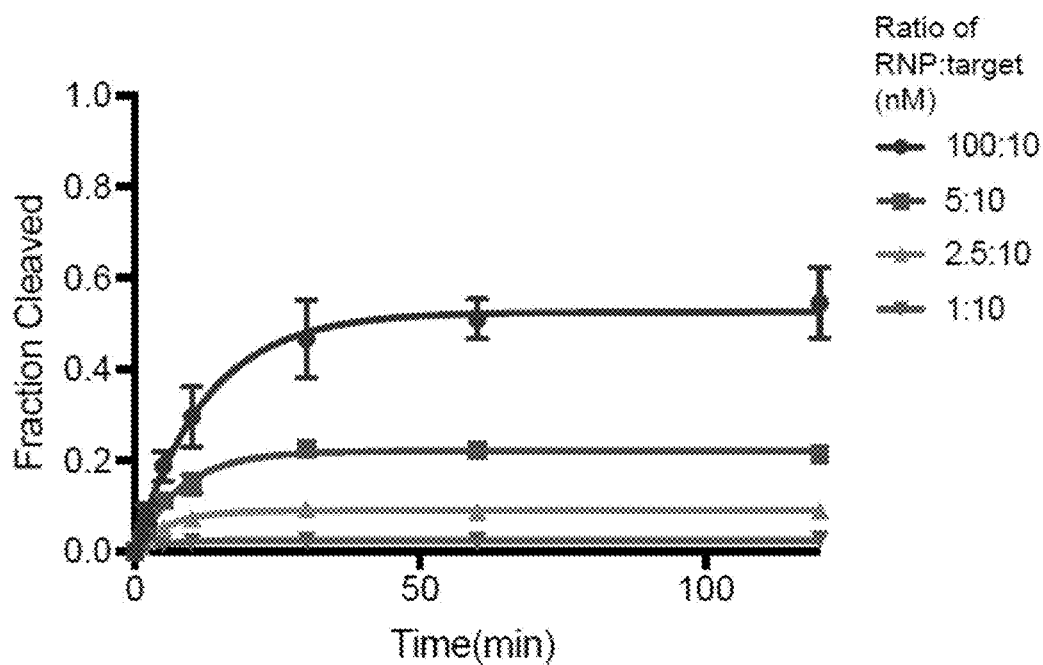

RNA cleavage activity and products were similar to those of canonical Cas9- mediated DNA cleavage activity in vitro. RNA targeting by SauCas9 requires the presence of a guide RNA and a catalytically-active protein, as both apo protein lacking the guide RNA and a catalytically inactive mutant (D10A and N580A) do not cleave RNA (FIG. 5A). Furthermore, addition of EDTA to chelate divalent metal ions abolished RNA cleavage, verifying that divalent metal ions are necessary for catalysis. As with DNA substrates (see, e.g., Sternberg S H et al., "DNA interrogation by the CRISPR RNA-guided endonuclease Cas9," Nature 2014; 507(7490):62-7), incubation of SauCas9 with an excess of RNA target demonstrated that cleavage is single-turnover (FIG. 5B-5C).

Figure 5D:
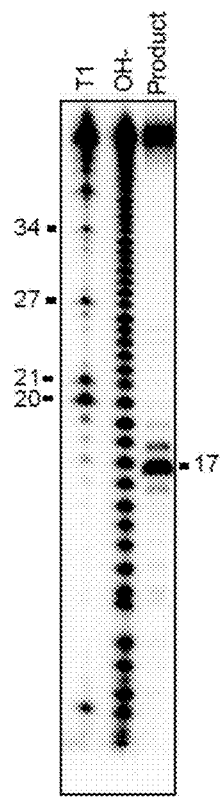
Figure 5E:
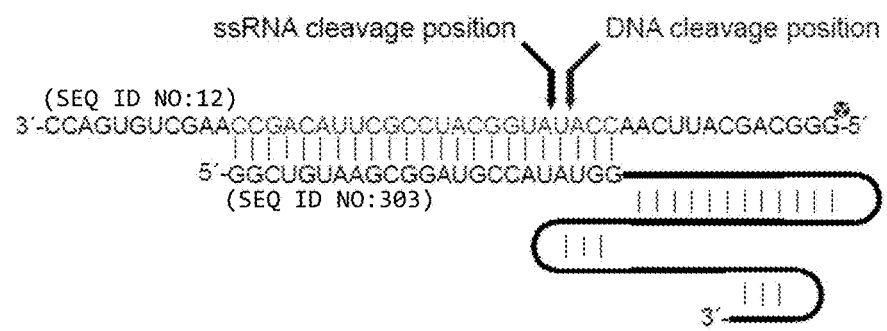
Figure 6A:
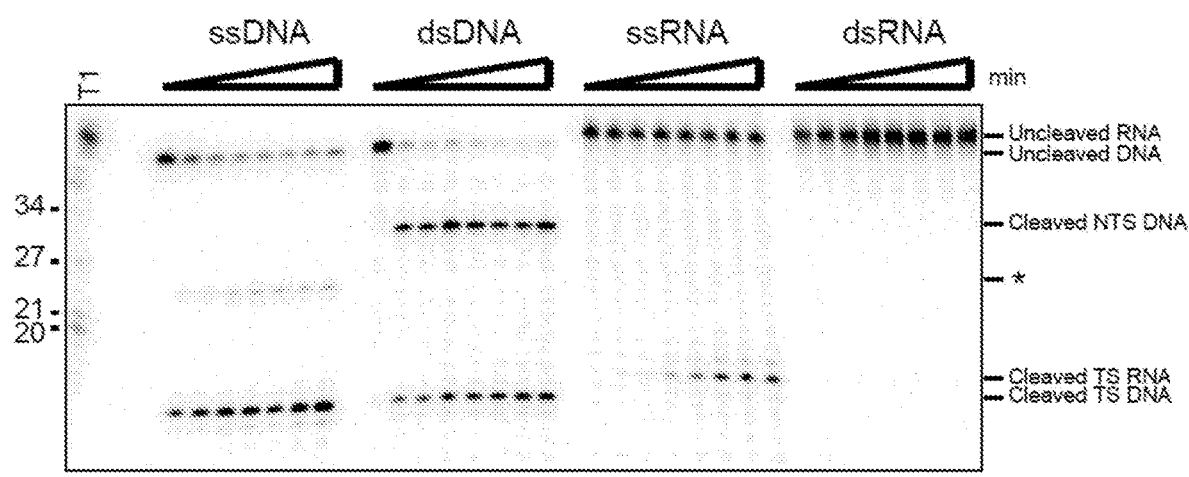
FIG. 6A-6D shows SauCas9 cleavage of different nucleic acid substrates. Representative cleavage assay of nucleic acid substrates (FIG. 6A, 6D) diagramed in FIG. 6B by SauCas9. Asterisk denotes an off-target cleavage site. Time points are 0, 1, 2, 5, 10, 30, 60, and 120 mins. T1 RNase digest size fragments are given on the left. Quantification (FIG. 6C) of results in FIG. 6A, 6D. Fit was determined in Prism using a single-exponential decay model. Error bars represent the mean±S.D. (n=3). Apparent pseudo-first order rate constant ($k_{cleave}$±S.D.) is given to the right of the substrate legend. "N.D." indicates that an accurate rate cannot be determined due to the reaction reaching completion before the second time point; and "n.s." indicates not significant.
Figure 6D:
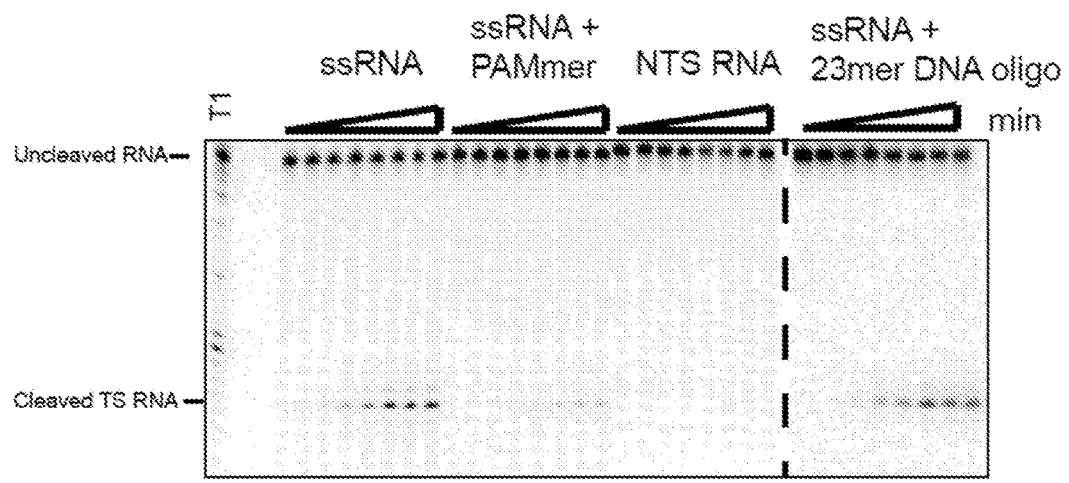
Figure 6B:
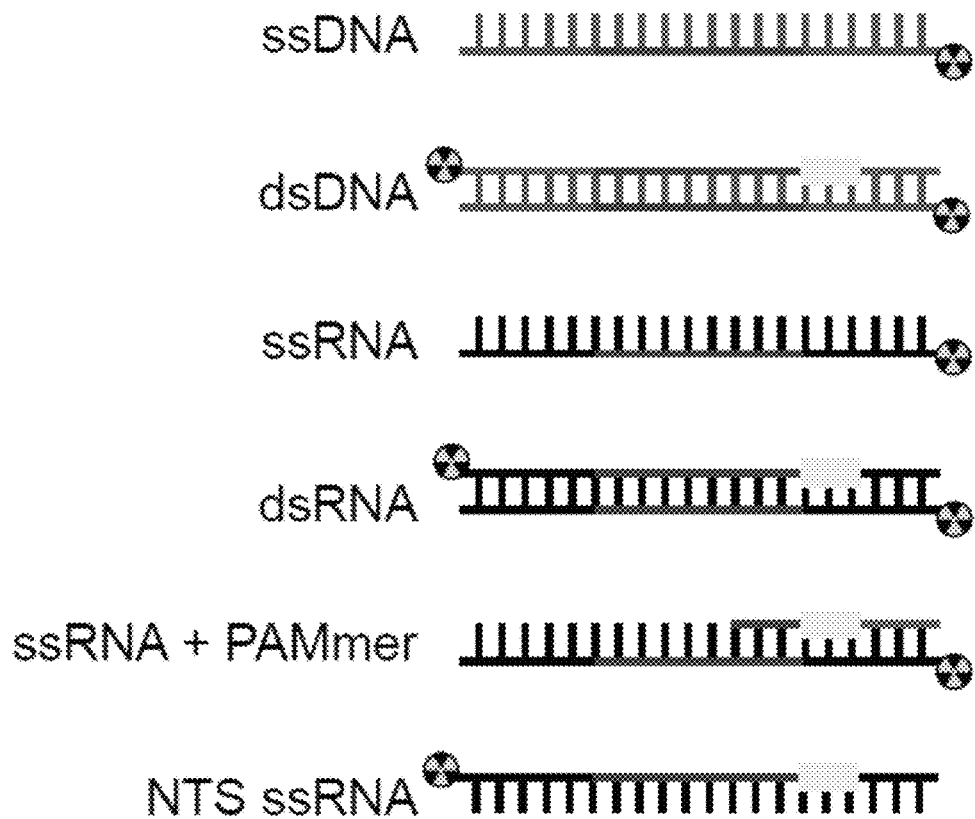
Figure 6C:
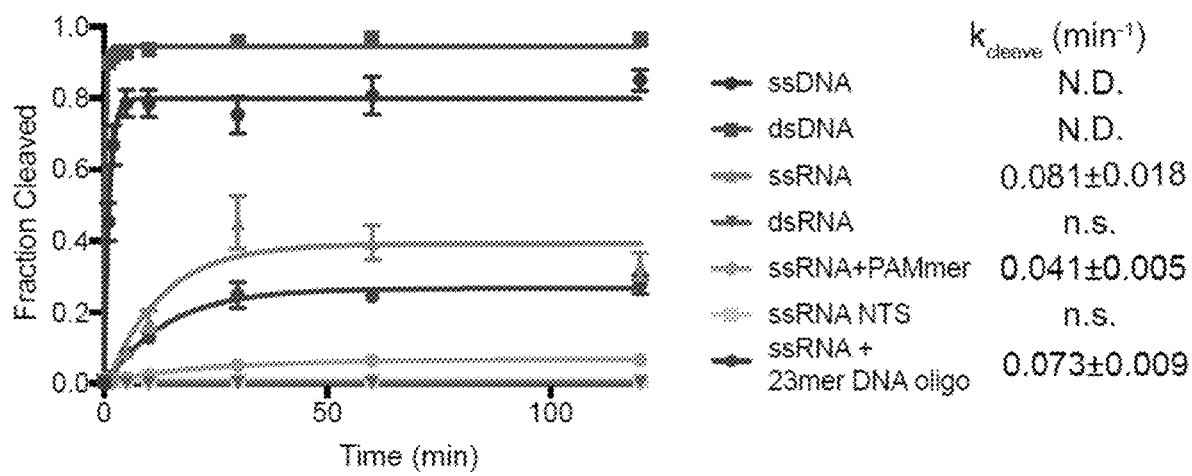

Hydrolysis mapping of the cleavage product revealed that the predominant RNA cleavage site is shifted by one nucleotide compared to the site of DNA cleavage (see, e.g., Garneau J E et al., "The CRISPR/Cas bacterial immune system cleaves bacteriophage and plasmid DNA," Nature 2010; 468(7320):67-71; Jinek M et al., Science 2012; 337 (6096):816-21; and Gasiunas G et al., Proc. Nat'l Acad. Sci. USA 2012; 109(39):E2579-86) (FIG. 5D-5E). The shift is consistent with that observed for PAM-dependent SpyCas9 RNA-cleavage. Without wishing to be limited by mechanism, this shift is likely due to the more compact geometry of an RNA-RNA helix relative to an RNA-DNA hybrid helix (see, e.g., O'Connell M R et al., Nature 2014; 516(7530): 263-6; and Wang A H et al., "Molecular structure of r(GCG) d(TATACGC): a DNA-RNA hybrid helix joined to double helical DNA," Nature 1982; 299(5884):601-4).

SauCas9 targets ssRNA in the absence of a PAMmer, a contrast to SpyCas9 targeting of ssRNA (see, e.g., O'Connell M R et al., Nature 2014; 516(7530):263-6). Testing SauCas9 in vitro ssRNA cleavage in the presence of a PAMmer (30× molar excess over ssRNA target) revealed that turnover was two-fold slower than the reaction with only target ssRNA (FIG. 3C and FIG. 6A-6D). SauCas9 ssRNA cleavage conducted in the presence of a non-complementary, control DNA oligo did not yield a similar reduction in cleavage rate (FIG. 6C), indicating that the complementary PAMmer impairs RNA cleavage activity. Consistent with cleavage being guide-dependent, single-stranded RNA that is not complementary to the sgRNA was not cleaved (FIG. 3C-3D and FIG. 6A-6D). Double-stranded RNA (dsRNA) was also not a substrate for SauCas9.

Figure 7D:
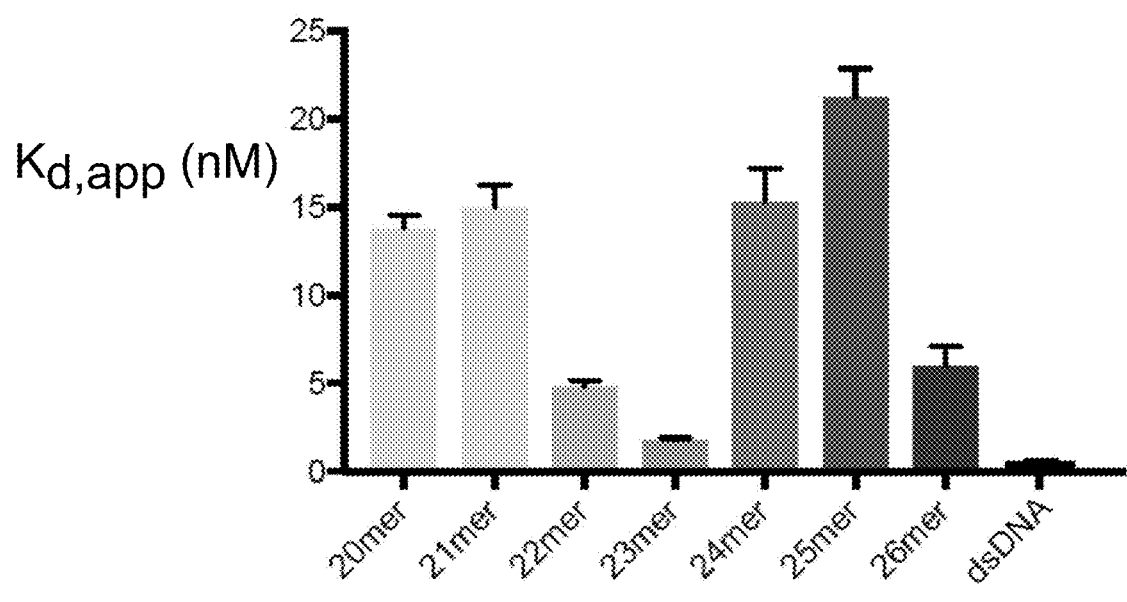

Given that Cas9 proteins are active with different length guide RNA segments (~20-24 nt) (see, e.g., Chylinski K et al., "The tracrRNA and Cas9 families of type II CRISPR-Cas immunity systems," RNA Biol. 2013; 10(5):726-37; Ran F A et al., Nature 2015; 520(7546):186-91; Friedland A E et al., Genome Biol. 2015; 16:257 (10 pp.); and Kim E et al., "In vivo genome editing with a small Cas9 orthologue derived from Campylobacter jejuni," Nat. Commun. 2017; 8:14500 (12 pp.)), we tested whether longer guide segments might enhance ssRNA targeting activity. Increasing the length of the targeting region of the guide up to 23 nt results in tighter binding and more efficient cleavage (FIG. 7A-7D), mirroring the preference for longer guides for DNA cleavage (see, e.g., Ran F A et al., Nature 2015; 520(7546):186-91; Friedland A E et al., Genome Biol. 2015; 16:257 (10 pp.)). Extending the guide strand complementarity to the target beyond 23 nt did not increase RNA target binding or cleavage efficiency, indicating that 23 nt is the optimal length for in vitro binding and targeting applications. The apparent dissociation constant ($K_{d,app}$) of the SauCas9-sgRNA complex (23 nt targeting region) for the ssRNA target was 1.8±0.09 nM (FIG. 7D), which is ~5× weaker than the 0.34±0.03 nM binding affinity measured for a dsDNA substrate of the same sequence.

Example 4: Cleavage Efficiency is Impaired by Duplex Regions in Target RNA

We noted that SauCas9-catalyzed ssRNA cleavage is limited to ~30% fraction cleaved (see FIG. 6A-6D), compared to >80% fraction cleaved for ssDNA and dsDNA targets. Greater thermodynamic stability of RNA secondary structures, relative to those in ssDNA (see, e.g., Bercy M et al., "Hairpins under tension: RNA versus DNA," *Nucleic Acids Res.* 2015; 43(20):9928-36) might occlude SauCas9-sgRNA binding to an ssRNA target sequence, a possibility that we tested using a panel of partially duplexed RNA substrates (FIG. 8A-8D).

Figure 8A:
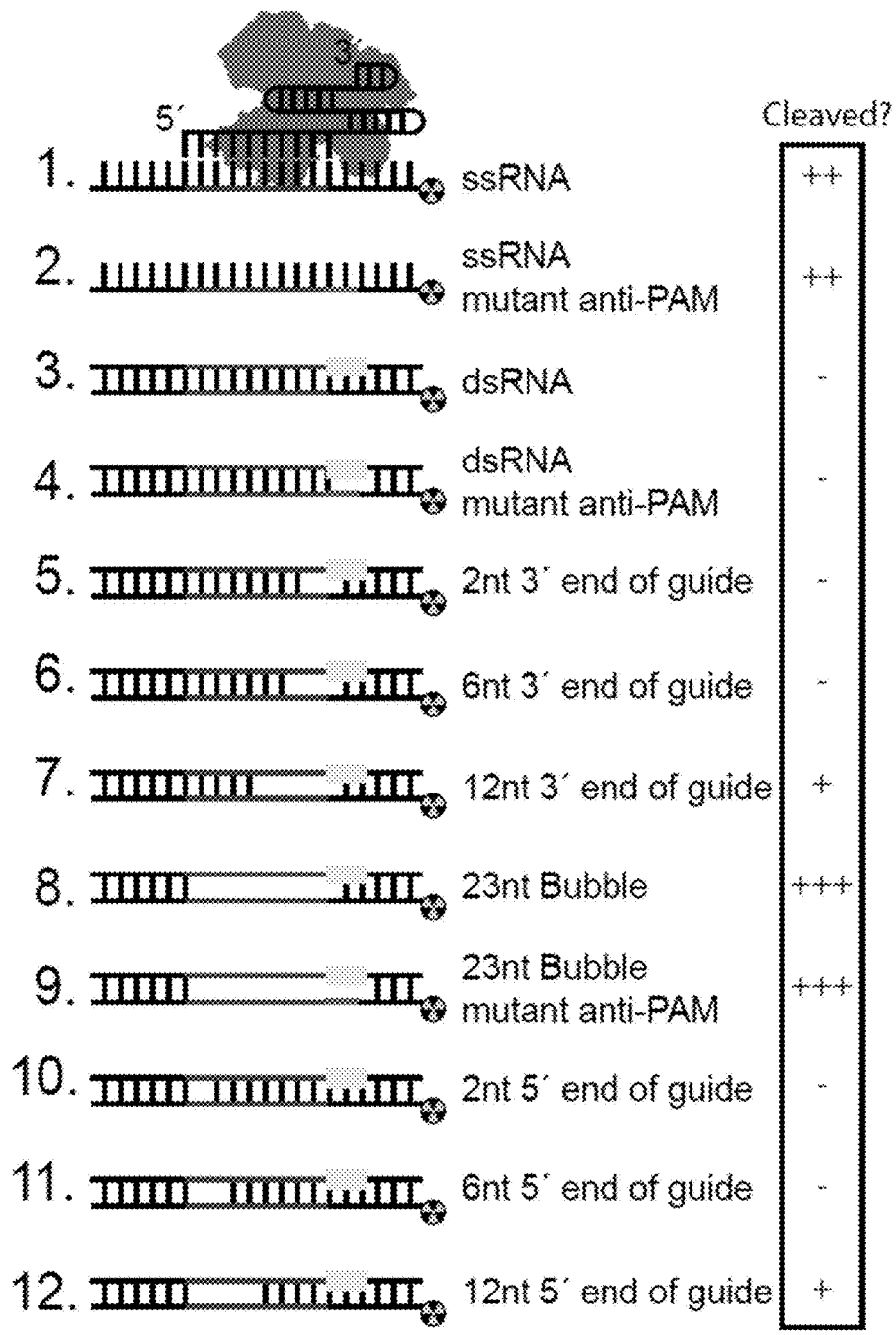
FIG. 8A-8D shows that in vitro RNA cleavage is impaired by strong secondary structure. Schematic representation of structured RNA targets (substrates 1 to 12) for in vitro cleavage assays (FIG. 8A). Symbols on right indicate relative level of cleavage activity for each substrate: no cleavage (−); low level of cleavage (+); medium level of cleavage (++); and high level of cleavage (+++). Representative cleavage assay (FIG. 8B) of partially-duplexed RNA targets diagrammed in FIG. 8A. T1 indicates size markers generated by RNase T1 digestion of ssRNA target. Size in nucleotides is indicated on the left. Fraction of target cleaved (FIG. 8C) and $K_{d,app}$ (FIG. 8D) for substrates diagrammed in FIG. 8A. Fits were determined in Prism using a single-exponential decay and a one-site binding model, respectively. Bars represent mean±S.D. (n=3); and "n.s." denotes no significant cleavage or binding.
Figure 8B:
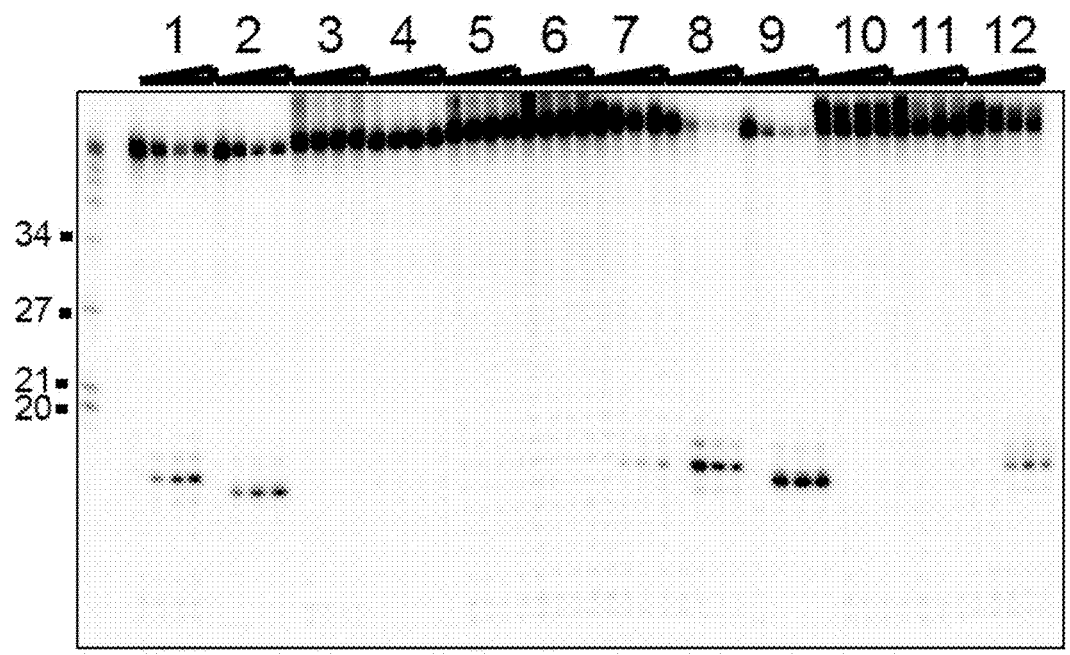

Previously, introduction of a short segment of mismatched base pairs to mimic partially unwound dsDNA substrates was shown to enhance the ability of type II-C Cas9s (including CjeCas9) to unwind and cleave dsDNA (see, e.g., Ma E et al., *Mol. Cell* 2015 Nov. 5; 60(3):398-407). Here, we found that RNA substrates containing a 2- or 6-base pair mismatched segment located near the 5' or 3' end of the 23 nt guide RNA region of the sgRNA could not be cleaved (FIG. 8A-8C, data for substrates 5, 6, 10, and 11). However, when the unpaired region was increased to 12-base pairs, SauCas9 was able to cleave the target strand. There was a slight cleavage preference for RNA substrates in which the 12-base pair mismatched segment is located near the 5' end of the guide sequence of the sgRNA (FIG. 8A-8C, data for substrates 7 and 12).

Figure 8C:
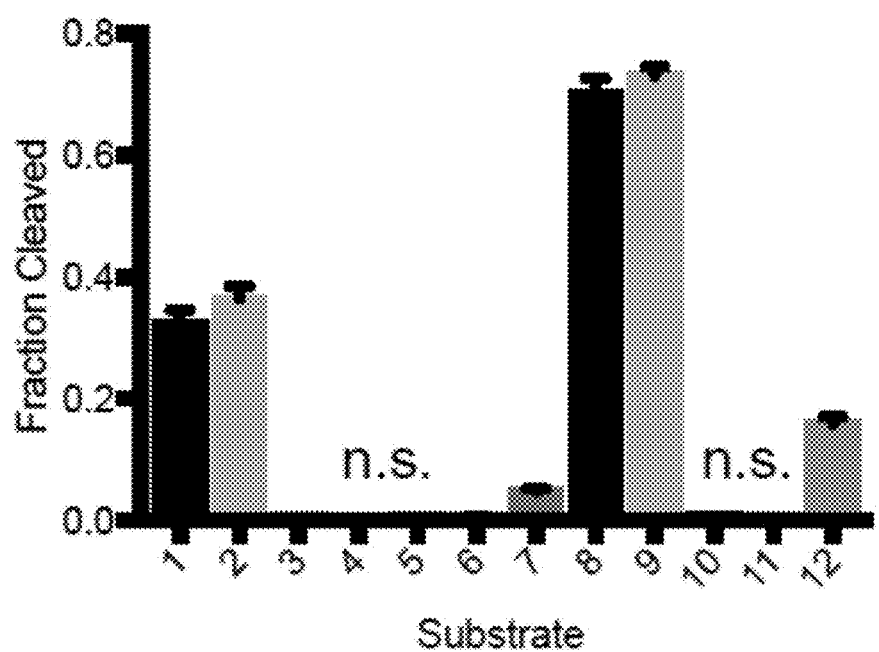
Figure 8D:
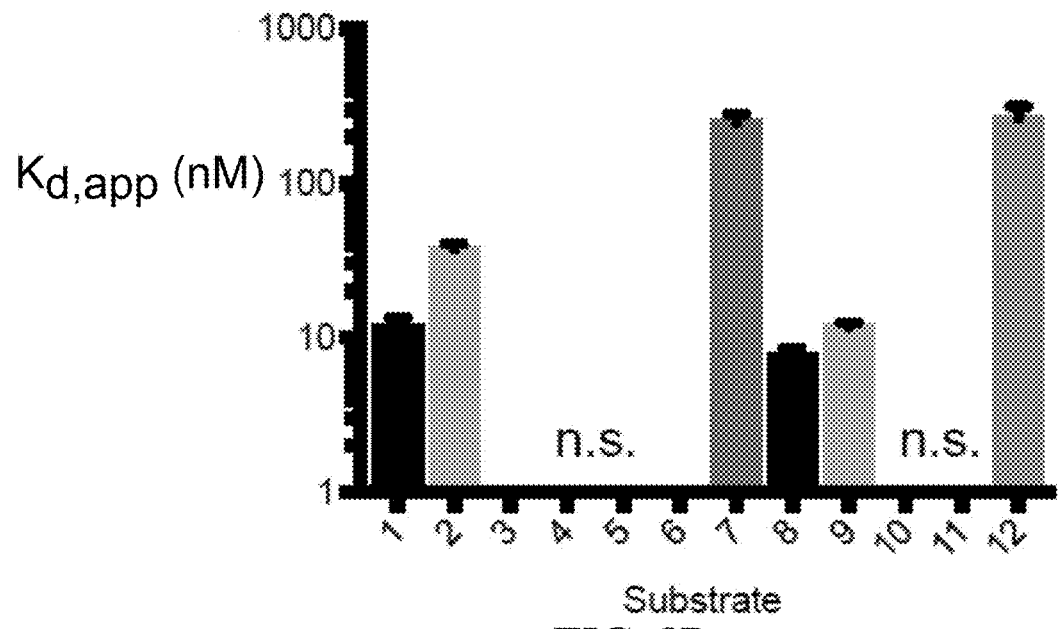
Figure 9A:
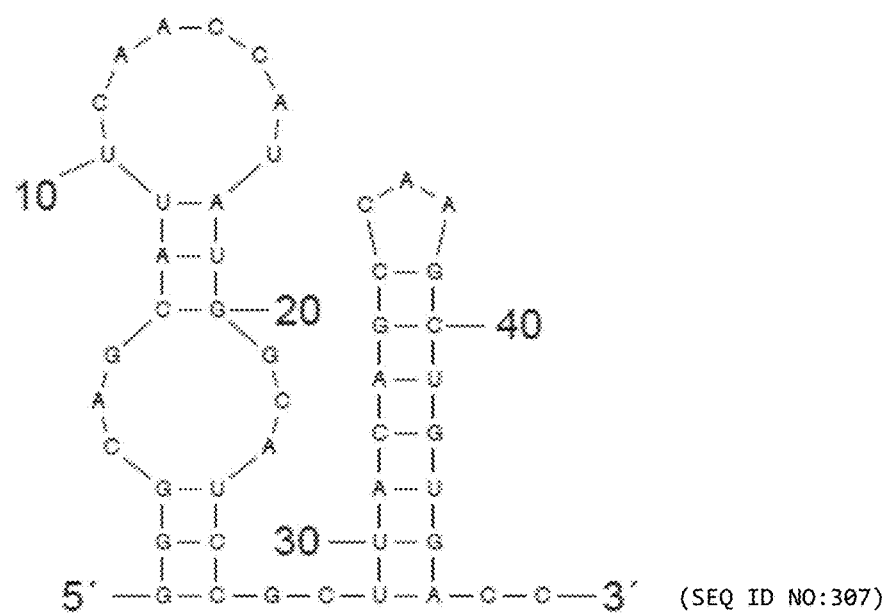
FIG. 9A-9E shows that RNA cleavage can be limited by the RNA target. Predicted secondary structure of target RNA used in this study (SEQ ID NO:307) (FIG. 9A). In vitro cleavage assay of ssRNA with SauCas9 was conducted for 2 hr (time points: 0, 1, 2, 5, 10, 30, 60, 120 mins) (FIG. 9B). The reaction was split, and SauCas9-sgRNA RNP or apo SauCas9 were added. The reaction was further incubated at 37° C., and data at additional time points were taken to check for additional cleavage of the target. Time points were taken at 0, 1, 2, 5, 10, 30, 60, and 120 mins post-RNP/apo SauCas9 addition. Fit (FIG. 9C) for data in FIG. 9B was determined in Prism using a single-exponential decay model. Error bars represent the mean±S.D. (n=3). In vitro cleavage assay of two ssRNA targets added sequentially (FIG. 9D). After 60 min incubation of SauCas9 with the pUC target, another target containing either the same recognition sequence (ON target—Reaction 1) or an unrelated sequence (OFF target—Reaction 2) were added to the reaction. Cleavage was assayed for an additional 60 mins (time points: 0, 10, 30, 60 min). Reactions containing only the second target (Reactions 3 and 4) were conducted with SauCas9 RNP that was incubated for 60 min at 37° C. prior to addition to the cleavage reaction. Quantification (FIG. 9E) of cleavage of second target in FIG. 9D for time points after addition. Fit was determined in Prism using a single-exponential decay model. Error bars represent the mean±S.D. (n=3).

Interestingly, the 23-base pair mismatched segment RNA substrates ('Bubble' substrates 8 and 9) are targeted more efficiently than their ssRNA counterparts (substrates 1 and 2) (FIG. 8C). We measured the binding affinity of all substrates and found that both the 23-base pair mismatched segment RNA and ssRNA substrates are bound with similar affinity (FIG. 8D). Furthermore, the apparent difference in cleavage efficiency was not due to the presence of a double-stranded PAM sequence, as mutating the PAM region does not impair cleavage (FIG. 8C, compare substrates 8 and 9). We hypothesize that RNA containing a mismatched segment presents a more accessible substrate to the Cas9-sgRNA complex due to stable annealing between the ends of the non-target and target strands, whereas the ssRNA substrate alone has ends that are predicted to stabilize a conformation that is partially structured and therefore inaccessible (FIG. 9A).

Figure 9B:
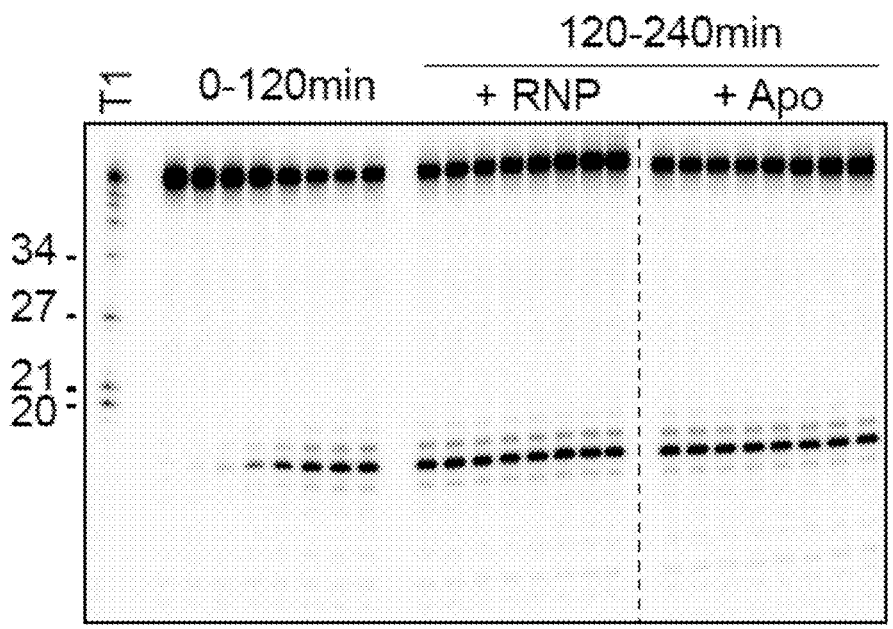
Figure 9C:
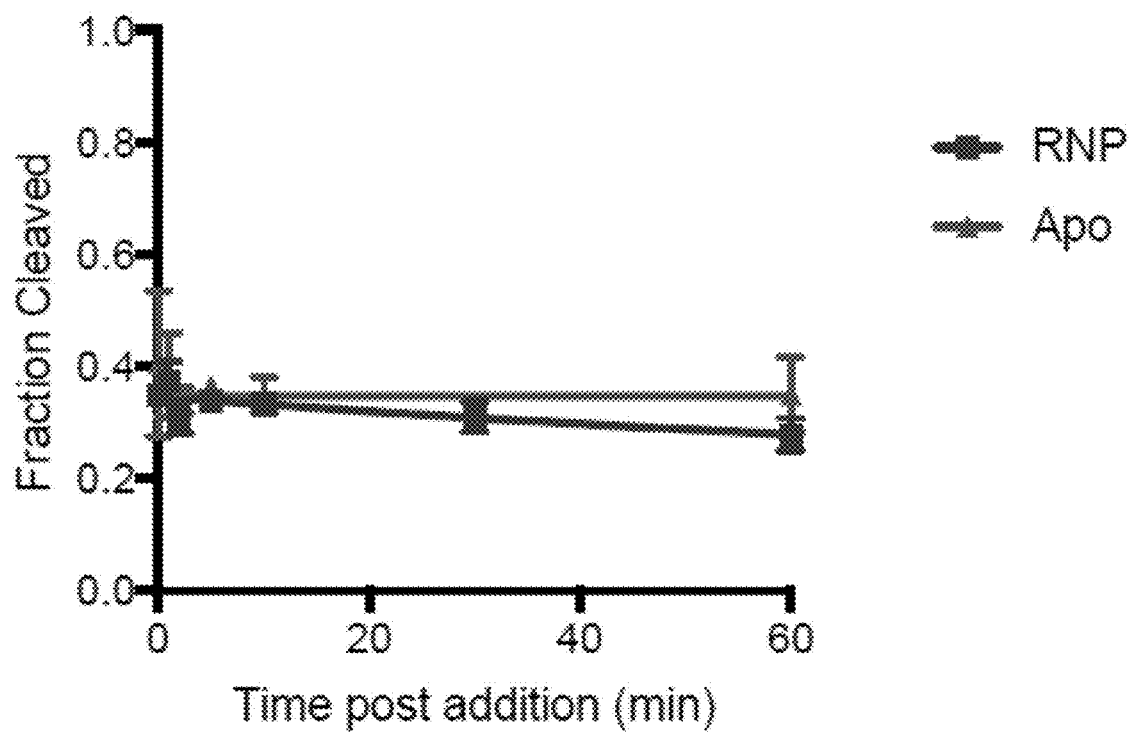
Figure 9D:
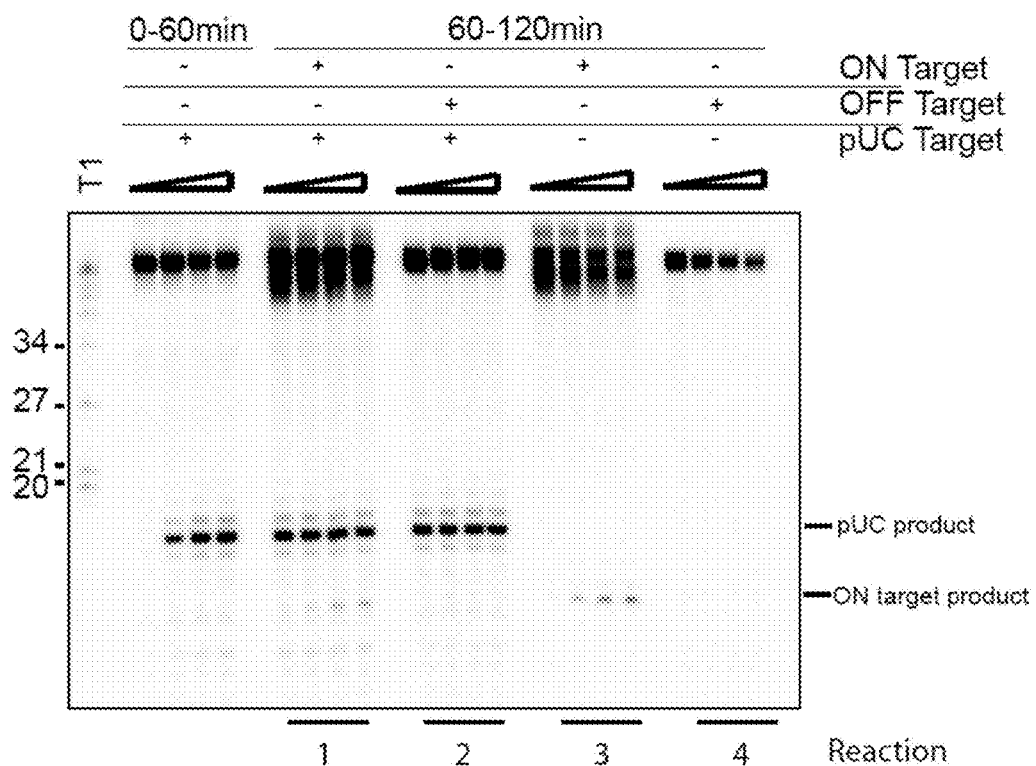
Figure 9E:
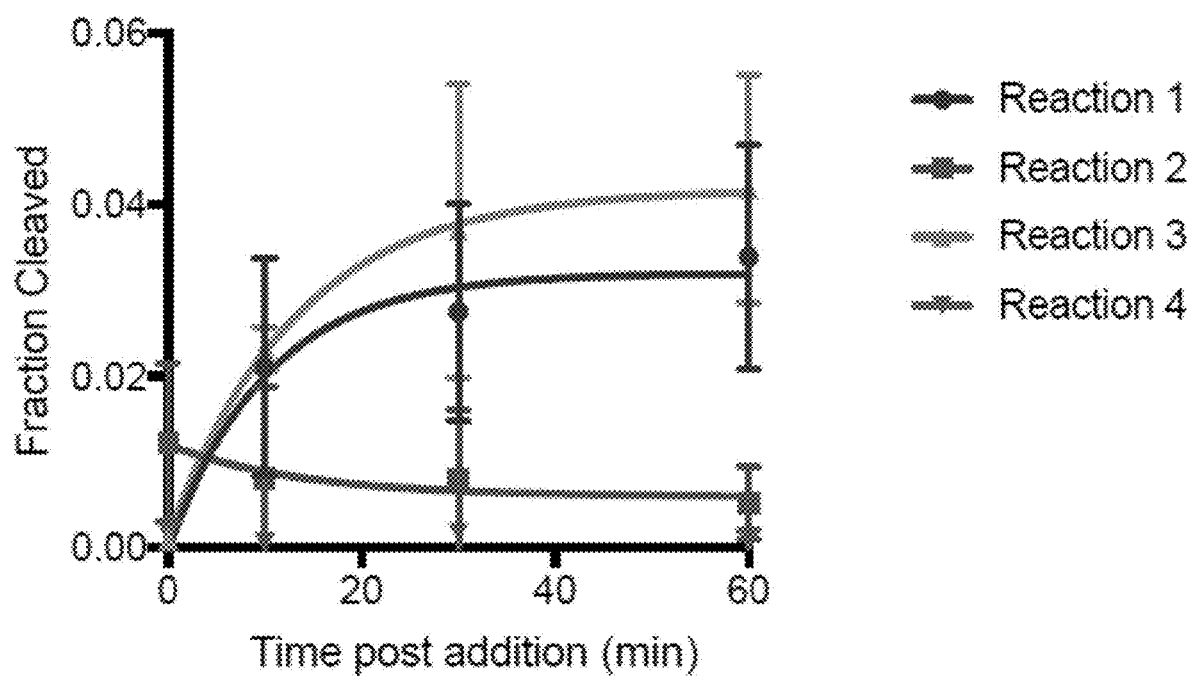

An alternative hypothesis to explain the limited cleavage of ssRNA substrates is that SauCas9 enzyme inactivation occurs over the course of the reaction, even with SauCas9 protein-sgRNA (ribonucleoprotein, RNP) present in 10-fold excess relative to the ssRNA substrate. To test this, we spiked reactions with fresh SauCas9 protein alone or SauCas9 RNP after reactions reached equilibrium; however, we did not observe an increase in the amount of ssRNA cleavage (FIG. 9B-9C). We also tested whether the SauCas9 RNP was able to cleave a second ssRNA substrate that was added to the reaction after it reached completion (FIG. 9D-9E). After 1 hr of incubation, the addition of a second target ssRNA complementary to the guide RNA resulted in a burst of cleavage activity, whereas a non-complementary ssRNA substrate did not stimulate cleavage. The second target ssRNA was cleaved to a comparable extent to that observed when this second target was the only substrate in the reaction (FIG. 9D-9E, compare reactions 1 and 3).

These observations suggest that SauCas9 RNP is still competent and available for cleavage at the end of the reaction and that a property intrinsic to the ssRNA substrate is the limiting factor. We propose that the observed difference in cleavage extents for various RNA substrates reflects the fraction of molecules that are structurally accessible for cleavage by the SauCas9 RNP.

Example 5: SauCas9 Confers In Vivo Protection Against RNA Phage

Figure 10A:
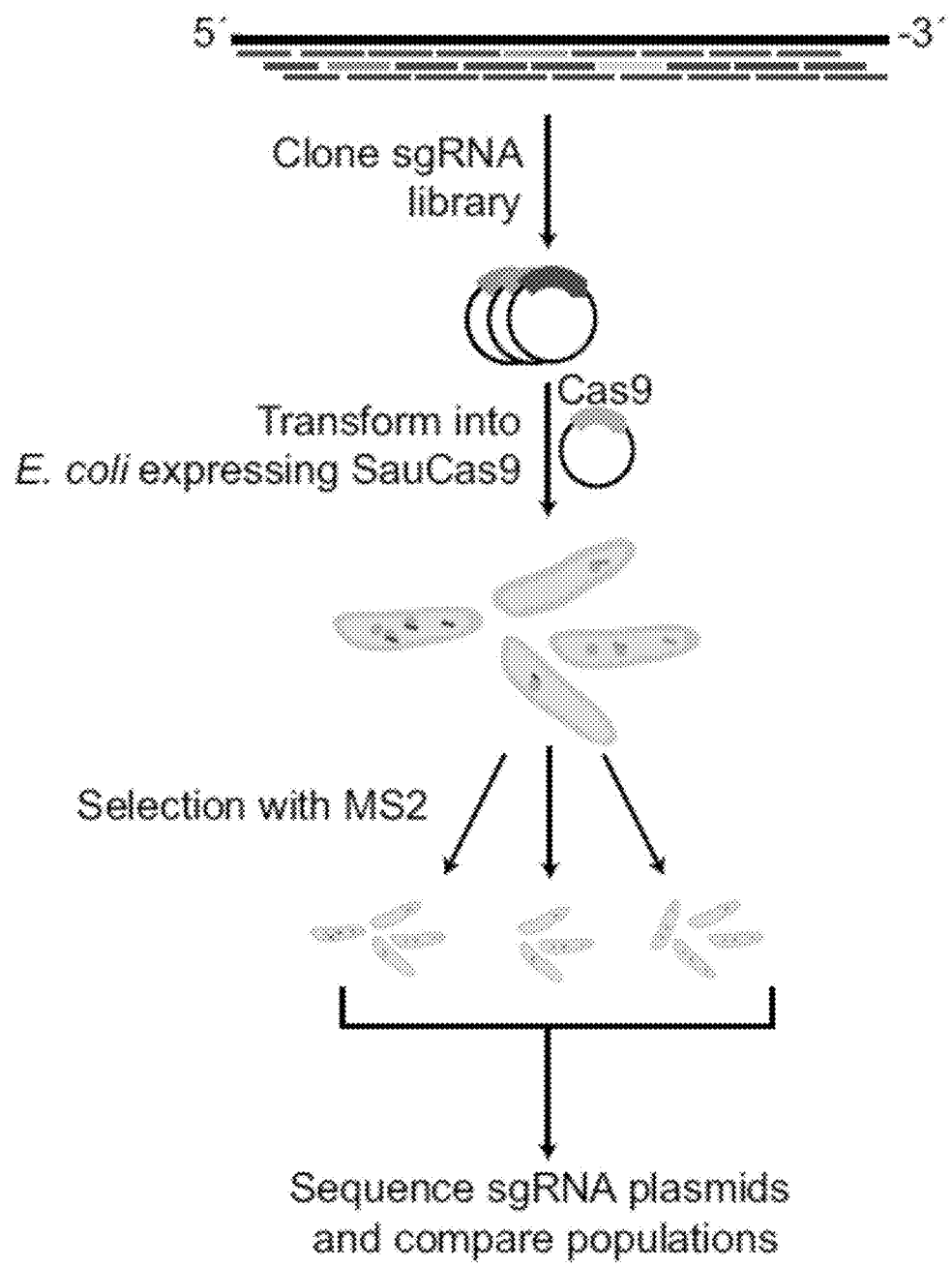
FIG. 10A-10F shows that SauCas9 confers in vivo protection against an RNA phage. Overview of MS2 targeting screen (FIG. 10A). Guides tiled against the library were cloned into sgRNA expression plasmids and co-transformed into E. coli with a plasmid containing wild-type SauCas9 under inducible control. Plasmids from surviving colonies after MS2 selection were recovered and sequenced. For more detail, see Example 2 herein. Number of guides with significant positive enrichment from three biological experiments (FIG. 10B), in which guides included those that were control (Control), perfect complementarity matches (Perfect), or guides with a single-nucleotide (SNP) mismatch. Box and whiskers plot of average $\log_2$ fold-change of perfect MS2 guides by length (FIG. 10C). Whiskers represent 5% and 95% values with outliers graphed as points. *p<0.05, p<0.01, **p<0.0001, by one-way ANOVA. $\log_2$ fold-change plot of guides with an FDR-corrected p-value <0.05 mapped to the MS2 genome for multiplicities of infection (MOI) of 100 (MOI-100) treatment, in which a schematic of MS2 genome is provided above the plot (FIG. 10D, upper). Individual guides mapped to highlighted regions of MS2 genome (FIG. 10D, lower). Other graphs for MOI-10 and MOI-100 treatments are presented FIG. 11A-11D. Representative plaque assay of SauCas9 in vivo protection (FIG. 10E). E. coli containing constructs on the right are spotted with various phage dilutions as indicated. Scr signifies that the targeting portion of the guide has been scrambled to serve as a non-targeting control. Relative plaque forming units (PFU) (mean±S.D., n=3) (FIG. 10F) from results in FIG. 10E. More guides and controls are presented in FIG. 13A-13E.

Based on the biochemical ability of SauCas9 RNP to bind and cleave ssRNA substrates, we wondered whether this activity might provide protection against RNA phage infection in bacteria. To test this, we generated a plasmid library encoding sgRNAs containing guide sequences complementary to the genome of MS2, a single-stranded RNA phage that can infect *E. coli*. A subset of these sgRNAs contained scrambled guide sequences that should not target MS2, providing negative controls. Another sgRNA subset included single-nucleotide mismatches introduced at each position of a target sequence to test for mismatch sensitivity in ssRNA recognition. This plasmid library, comprising 18,114 sgRNAs (SEQ ID NOs:334-18447), was co-transformed into *E. coli* along with a vector encoding a catalytically active version of SauCas9, and the population of transformants was subjected to infection by bacteriophage MS2 (FIG. 10A). The experiment was performed in biological triplicate and included an untreated control population and two experimental conditions (multiplicities of infection (MOIs) of 10 and 100). After selection, plasmids were recovered from surviving colonies and sequenced (FIG. 10A).

Figure 10B:
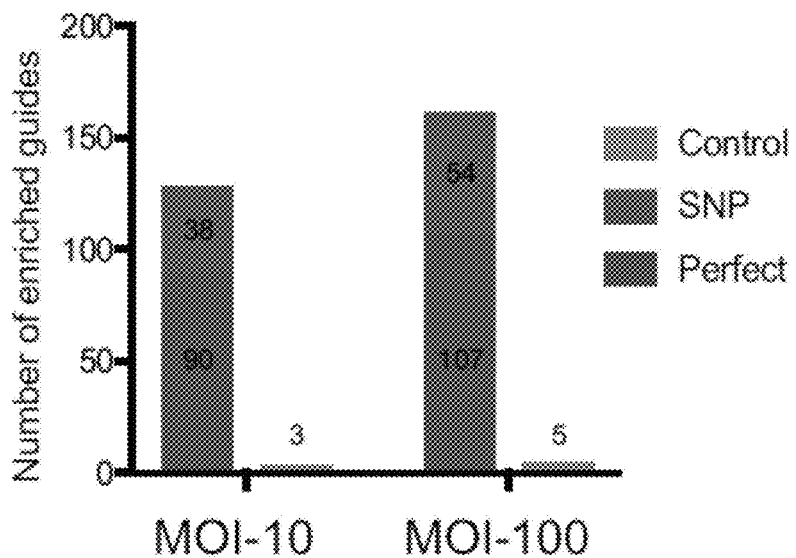

We identified between 131 and 166 sgRNAs that were significantly enriched (false discovery rate (FDR)-adjusted p-value <0.05) in the two different MS2 infection conditions (FIG. 10B). The majority of these sgRNAs were perfectly complementary to the MS2 genome, and only three and five control sgRNAs (out of 708 total control sgRNAs) for the MOI-10 and MOI-100 conditions, respectively, were enriched (FIG. 10B).

The lengths of enriched guide sequences were skewed towards shorter targeting lengths (FIG. 11A, left); however, this likely reflects bias in the cloned input library since the ratio between the enriched guide sequences and those of the library without phage selection are similar (FIG. 11A, right).

Figure 10C:
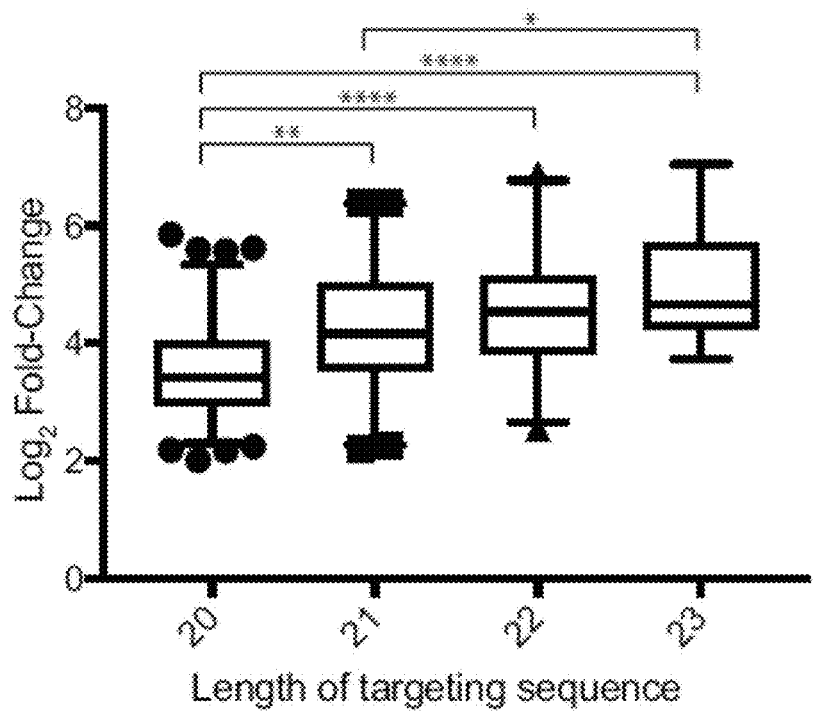

When comparing the degree of enrichment between the different guide lengths, the 23-nt guide segment sgRNAs were preferentially enriched over those of shorter length (FIG. 10C), consistent with the in vitro observation that longer guides are more efficient for directing ssRNA cleavage (see, e.g., FIG. 7C). To assess whether there was any sequence bias within the enriched guides, we aligned guide sequences of all lengths at their 3' end. These alignments showed no specific sequence bias in the enriched guides relative to those in the unselected library (FIG. 11B). This is consistent with the crystal structure of an SauCas9-sgRNA-DNA bound complex which revealed the absence of base-specific contacts of Cas9 to the target strand (see, Nishimasu H et al., *Cell* 2015; 162(5):1113-26; and Nishimasu H et al., "Crystal structure of Cas9 in complex with guide RNA and target DNA," *Cell* 2014; 156(5):935-49).

Figure 10D:
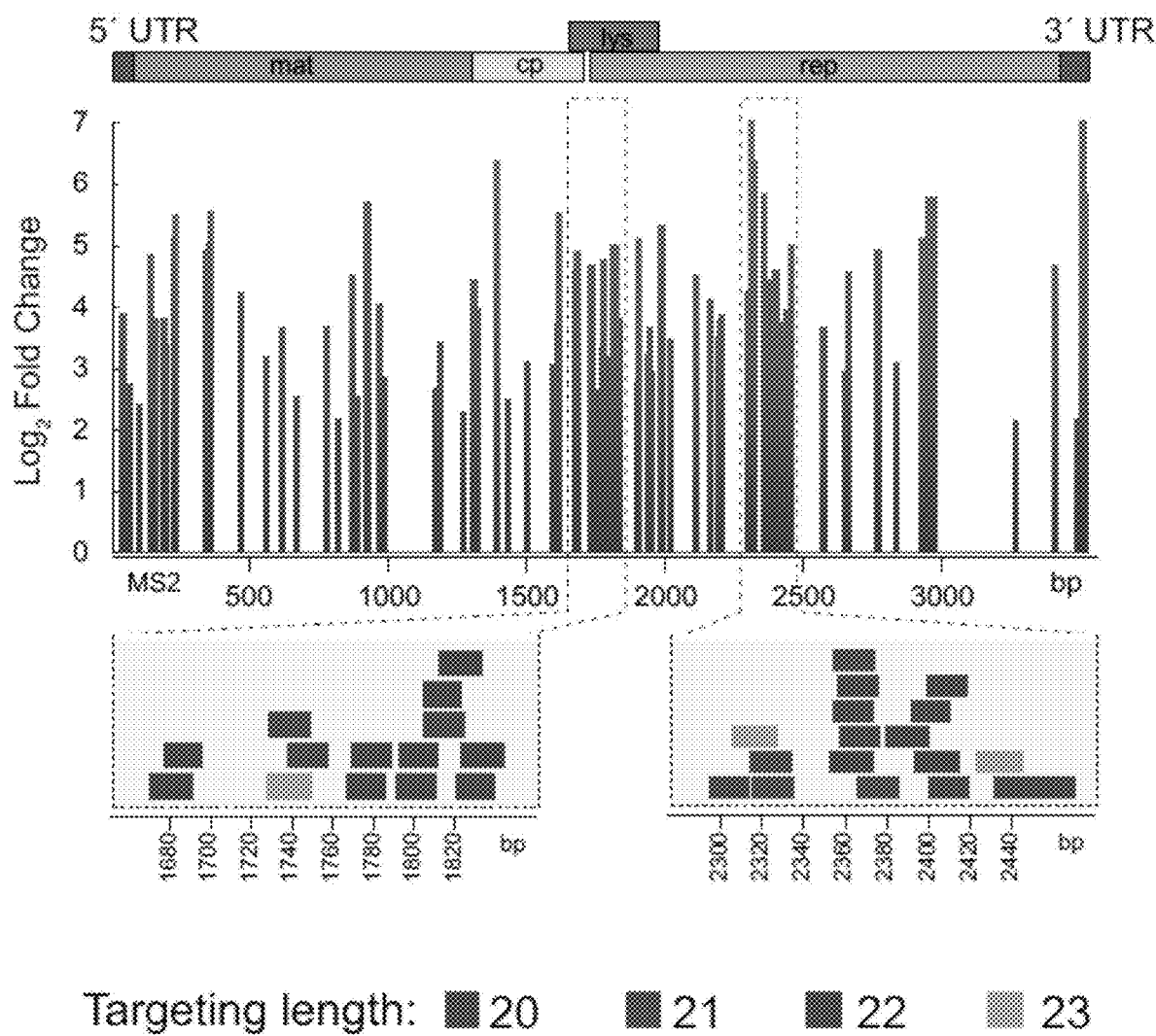

Strikingly, mapping enriched guide sequences onto the MS2 genome showed that enriched sgRNAs were clustered at specific regions, which were consistent across both experimental conditions (FIG. 10D and FIG. 11C-11D). Together with our biochemical data suggesting that SauCas9 cannot bind or cleave structured RNAs (see, FIG. 10A-10F), we interpret these targeting "hotspots" to be regions of low structural complexity. It is important to note that sgRNAs containing different guide segment lengths overlap at these regions, possibly indicating that increases in targeting efficiency due to guide length are secondary to target accessibility to the Cas9 RNP. We mapped the enriched guide sequences onto the published secondary structure of the MS2 genome determined through cryoelectron microscopy (see, e.g., Dai X et al., *Nature* 2017; 541(7635):112-6) (FIG. 12). Guides targeted not only single-stranded, accessible regions but also those that form apparently stable secondary structures. The structure of the MS2 genome was determined on the intact phage particle, however, and may not represent the RNA structure(s) relevant to the infection stage during which SauCas9-mediated protection is crucial.

Figure 10E:
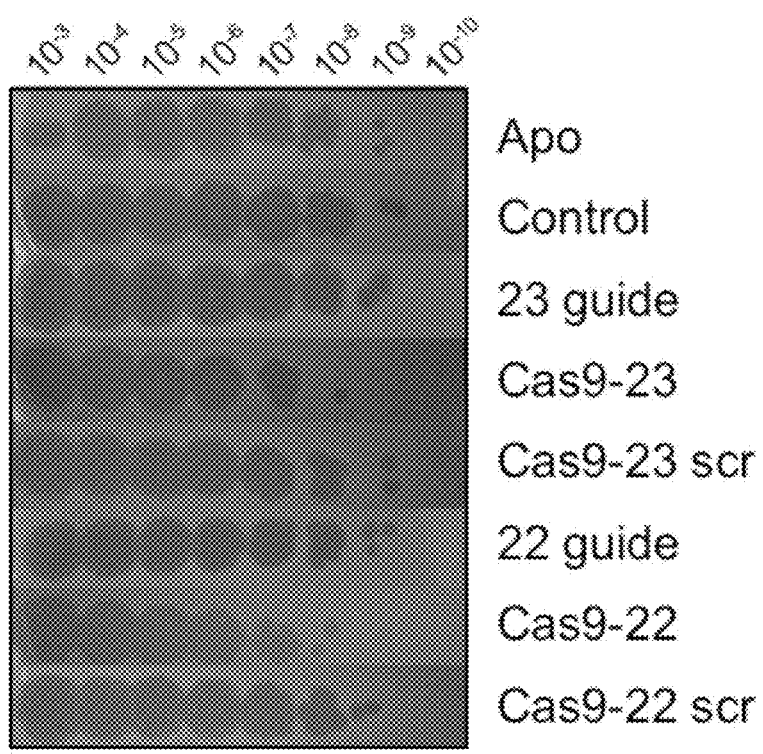
Figure 10F:
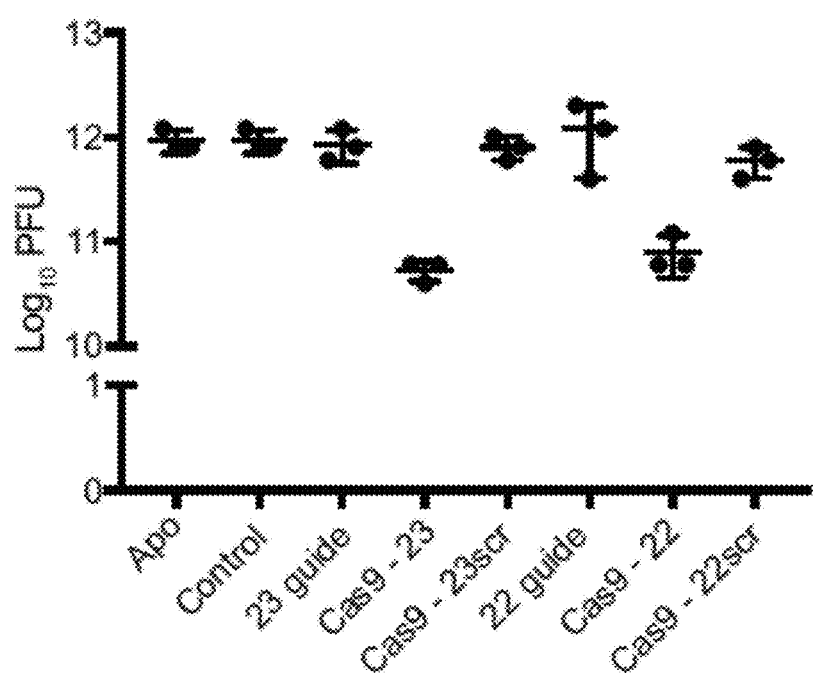

Highly enriched sgRNAs from the screen were confirmed for their ability to confer protection against MS2 phage infection through a soft-agar plaque assay. Reconstitution of SauCas9 with a targeting guide confers approximately a ten-fold protection against the RNA phage (FIG. 10E-10F). No protection was observed in the absence of an sgRNA or SauCas9 protein. Scrambling the sequence of the guide also abrogates protection, confirming that sequence complementary is necessary for phage elimination.

Guide segments of all lengths tested (20-23 nts) conferred protection to a similar level (FIG. 13A,13C), consistent with the result from the MS2 screen that guide segments of all lengths were enriched in 'hotspot' regions (FIG. 10D). Two 'control' guides were enriched in both the MOI-10 and MOI-100 treatments. Interestingly, both guides conferred protection but their scrambled counterparts did not (FIG. 13B,13D). Whereas a possible off-target binding site was found for one guide (#14238, SEQ ID NOs:308, 309, and 14571) within the MS2 genome (FIG. 13E), it remains unclear how guide #14210 (SEQ ID NO:14543) confers protection. Without wishing to be limited by theory, possibly this sgRNA acts by targeting an *E. coli* host factor that is necessary for infection.

Screening against the MS2 genome was also used to test the effect of single-nucleotide mismatches on SauCas9's targeting ability. We computed an average fold change (between phage treated and untreated samples) for all sgRNAs that contained a mismatch at the same position, and obtained average values for mismatches at each position across the guide. We observed a pronounced gradient of increasing guide stringency with length. On average, short guides were less sensitive to mismatches, while mismatches in longer sgRNAs led to decreased recovery compared to control samples (FIG. 14A-14B).

Previous work and models suggest that shorter guide segments should be more sensitive to mismatches and lead to higher fidelity Cas9 targeting (Fu Y et al., "Improving CRISPR-Cas nuclease specificity using truncated guide RNAs," *Nat. Biotechnol.* 2014; 32(3):279-84; and Bisaria N et al., "Lessons from enzyme kinetics reveal specificity principles for RNA-guided nucleases in RNA interference and CRISPR-based genome editing," *Cell Syst.* 2017; 4(1): 21-9). Further study could elucidate further insights into this unexpected pattern of RNA-targeting stringency, as one shortcoming of this experiment is that mismatched guides were not designed a priori to recognize accessible parts of the MS2 genome.

Figure 14D:
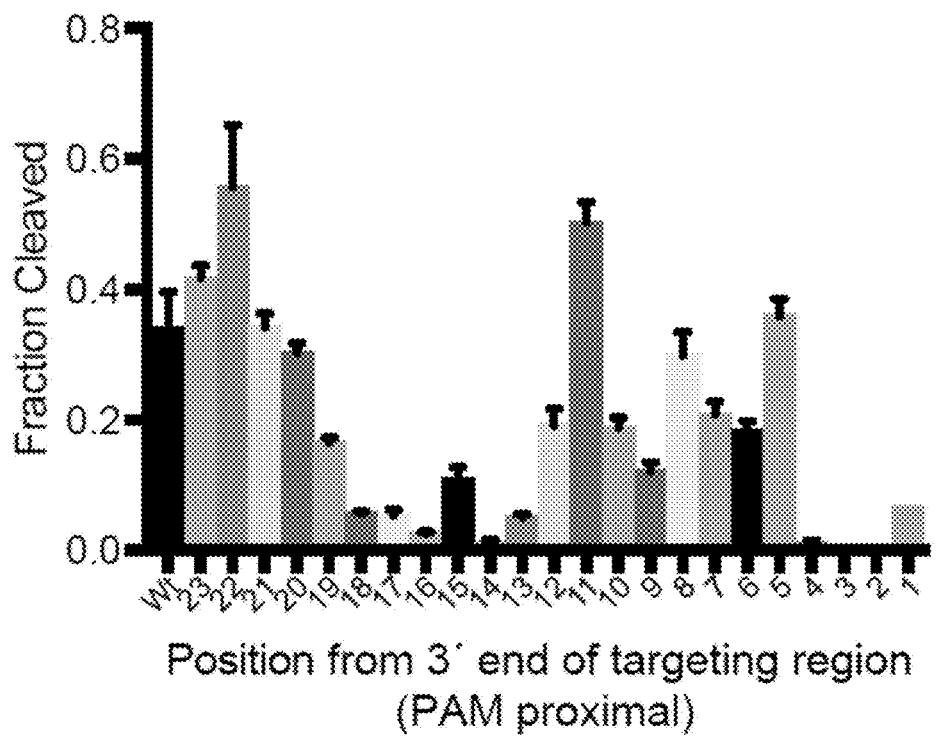

Nevertheless, despite potential noise introduced in this analysis due to guide segments that target inaccessible MS2 regions, we observe an interesting correlation between mismatches in the MS2 screen and in vitro biochemical cleavage assays for the sgRNA with a 23 nt guide segment sequence (FIG. 14C-14D). The first few nucleotides in the 'seed' region (guide 3' end proximal) are sensitive to mismatches, while a central region of sensitivity is also observed, similar to previously demonstrated regions of sensitivity for SpyCas9 DNA cleavage (Cong L et al., "Multiplex genome engineering using CRISPR/Cas systems," *Science* 2013; 339(6121):819-23; Jiang W et al., "RNA-guided editing of bacterial genomes using CRISPR-Cas systems," *Nat. Biotechnol.* 2013; 31(3):233-9; Fu B X et al., "Distinct patterns of Cas9 mismatch tolerance in vitro and in vivo," *Nucleic Acids Res.* 2016; 44(11):5365-77; and Gorski S A et al., "RNA-based recognition and targeting: sowing the seeds of specificity," Nat. Rev. *Mol. Cell Biol.*

Example 6: SauCas9 Represses mRNA Translation in *E. coli*

An efficient RNA-targeting Cas9 could serve as an important tool in regulating gene expression in vivo. To test the ability of SauCas9 to mediate repression of host gene translation, we targeted dSauCas9 and dSpyCas9 RNPs to a GFP reporter sequence encoded in the *E. coli* chromosome (see, e.g., Qi L S et al., "Repurposing CRISPR as an RNA-guided platform for sequence-specific control of gene expression," *Cell* 2013; 152(5):1173-83). Catalytically inactive versions of Cas9 were used to prevent cleavage of the bacterial chromosome when targeting a site adjacent to a PAM. As expression of Cas9 and sgRNA exerts metabolic stress on *E. coli*, GFP fluorescence values were normalized by the $OD_{600}$ value to account for differences in cell growth between cultures (see, e.g., Oakes B L et al., "Profiling of engineering hotspots identifies an allosteric CRISPR-Cas9 switch," *Nat. Biotechnol.* 2016; 34(6):646-51).

When using sgRNAs designed to recognize a sequence in the GFP gene adjacent to the appropriate PAM for SauCas9 (NNGRRT) or SpyCas9 (NGG), GFP expression was significantly reduced (FIG. 15A) consistent with CRISPR-interference (CRISPRi) (see, e.g., Qi L S et al., *Cell* 2013; 152(5):1173-83; and Gilbert L A et al., "Genome-scale CRISPR-mediated control of gene repression and activation," *Cell* 2014; 159(3):647-61). When sgRNAs were designed to recognize GFP sequences not flanked by a PAM, dSauCas9 but not dSpyCas9 was able to repress GFP expression. The SauCas9-mediated GFP repression was dependent on sgRNAs that target the coding strand; sgRNAs that recognize the non-coding strand did not result in reduced GFP expression (FIG. 16A). The length of the targeting sequence in vivo corroborates in vitro data, with longer guides working more efficiently (FIG. 15B).

Different guide sequences displayed variable efficiencies of targeting. We tiled sgRNAs across the GFP mRNA sequence to test the robustness of dSauCas9 to repress GFP expression (FIG. 15C). As no sites were adjacent to PAM sequences, all repression should occur on the translational level. The efficiency of dSauCas9-mediated GFP repression varied according to the target sequence, with some dSauCas9 RNPs reducing GFP signal to 15-30% of that observed in the presence of the sgRNA alone (FIG. 15C, data for substrates GFP2 and GFP6) and others showing no ability to repress GFP expression (FIG. 15C, data for substrates GFP7 and GFP9).

Electrophoretic mobility shift assays support the conclusion that repression was not occurring at the dsDNA level by promiscuous PAM binding (FIG. 16B). Repression was largely equivalent between catalytically active and inactive forms of SauCas9 (FIG. 16C), suggesting that binding of the Cas9-sgRNA complex to the mRNA was sufficient for repression. This understanding is consistent with in vitro data showing that the enzyme does not catalyze multiple-turnover RNA cleavage.

Together our biochemical and in vivo data support a model in which SauCas9 can readily bind and cleave bacteriophage RNA and mRNA sequences that are exposed and unstructured (FIG. 15D). Regions that form strong structures are relatively inaccessible to SauCas9 RNP binding, thereby preventing cleavage or repression activity in the studies described herein. Without wishing to be limited by theory, as Cas9 cleavage activity can be limited by target accessibility, we expect that RNA occluded by RNA-binding proteins may also be recalcitrant to cleavage.

Example 7: Potential Applications for RNA-Targeting CRISPR-Cas Systems

Prior investigations of CRISPR-Cas9 has generally focused on its function as a double-stranded DNA endonuclease, while the ability of diverse homologs to cleave natural RNA substrates has remained unexplored. Here, we present evidence that type II-A and type II-C Cas9 enzymes can catalyze programmable and PAM-independent single-stranded RNA cleavage. Focusing on SauCas9, we show that this enzyme can be employed both biochemically and in cells to cleave RNA and to regulate genes on both the transcriptional and translational level in parallel by accounting for target site PAM proximity.

Importantly, SauCas9 ssRNA scission requires only a sgRNA and does not need a PAMmer, thereby simplifying applications (see, e.g., Nelles D A et al., "Applications of Cas9 as an RNA-programmed RNA-binding protein," *Bioessays* 2015; 37(7):732-9) and facilitating delivery to cells as a pre-assembled RNP (see, e.g., Zuris J A et al., "Cationic lipid-mediated delivery of proteins enables efficient protein-based genome editing in vitro and in vivo," *Nat. Biotechnol.* 2015; 33(1):73-80; and Mout R et al., "Direct cytosolic delivery of CRISPR/Cas9-ribonucleoprotein for efficient gene editing," *ACS Nano* 2017; 11(3):2452-8).

The RNA-targeting capability of SauCas9 and related Cas9 enzymes offers the advantage of repressing viruses whose lifecycles do not involve a DNA genome or intermediate, thereby rendering them inaccessible to Cas9-mediated DNA cleavage. We demonstrated that SauCas9 could be programmed to confer protection to *E. coli* against MS2, an RNA bacteriophage with no DNA intermediate. Whether RNA-based viral repression by Cas9 occurs in natural systems is not known, but seems possible based on our results.

Intriguingly, 'hotspots' of preferential targeting emerged when tiling guides across the genome, but these sites were devoid of sequence bias. In conjunction with in vitro cleavage data of partially structured RNAs, we suggest that SauCas9 cleavage efficiency is inversely related to structural complexity of the RNA target. As an alternative to the current approach of screening multiple sgRNAs for activity, experimental knowledge about RNA structure, such as SHAPE-seq data (see, e.g., Loughrey D et al., "SHAPE-Seq 2.0: systematic optimization and extension of high-throughput chemical probing of RNA secondary structure with next generation sequencing," *Nucleic Acids Res.* 2014; 42(21): e165 (10 pp.)), could simplify target identification for viral targeting and repression experiments. Nevertheless, future work could concentrate on understanding the structural constraints on RNA targeting and methods to improve Cas9 access to duplex RNA regions.

SauCas9 holds promise for a range of RNA targeting applications. We showed that SauCas9 could repress mRNA translation in *E. coli*. Repression of the reporter occurred in the absence of the PAM and was specific for targeting of the coding strand. A programmable Cas9 capable of repressing genes on the RNA level has potential advantages over CRISPRi DNA-based techniques (see, e.g., Qi L S et al., *Cell* 2013; 152(5):1173-83; and Gilbert L A et al., *Cell* 2014; 159(3):647-61). For example, isoform-specific targeting of different transcripts originating from the same transcription start site or resulting from alternative splicing events might be possible. More broadly, due to its intrinsic ssRNA-binding activity, SauCas9 may have utility as a platform for directing other effector proteins to specific RNA molecules, such as proteins or domains that up-regulate translation or RNA base-modifying enzymes for site-specific epigenetic modification of RNAs.

Other Embodiments

All publications, patents, and patent applications mentioned in this specification are incorporated herein by reference to the same extent as if each independent publication or patent application was specifically and individually indicated to be incorporated by reference.

While the invention has been described in connection with specific embodiments thereof, it will be understood that it is capable of further modifications and this application is intended to cover any variations, uses, or adaptations of the invention following, in general, the principles of the invention and including such departures from the present disclosure that come within known or customary practice within the art to which the invention pertains and may be applied to the essential features hereinbefore set forth, and follows in the scope of the claims.

Other embodiments are within the claims.

SEQUENCE LISTING (18447 sequences)

SEQ ID NO: 1 - DNA, 102 bp, Artificial Sequence
  Synthetic construct
ggcuguaagcggaugccauaguuuuagagcuagaaauagcaaguuaaaauaaggcuaguccguuaucaacuugaaaaaguggcaccgagucggugcuuuuuu

SEQ ID NO: 2 - DNA, 104 bp, Artificial Sequence
  Synthetic construct
ggcuguaagcggaugccauauggguuuuaguacucuggaaacagaaucuacuaaaacaaggcaaaaugccguguuuaucucgucaacuuguuggcgagauuuuu

SEQ ID NO: 3 - DNA, 140 bp, Artificial Sequence
  Synthetic construct
ggcuguaagcggaugccauauguuuuagucccuuuuuaaauuucuuuaugguaaaauuauaaucucauaagaaauuuaaaaagggacuaaaauaaagaguuugcgggacucugcgggguuacaauccccuaaaaccgcuu

SEQ ID NO: 4 - DNA, 94 bp, Artificial Sequence
  Synthetic construct
ggcuguaagcggaugccauauguuucaguugcgccgaaaggcgcucuguaaucauuuaaaaguauuuugaacggaccucuguuugacacgucug

SEQ ID NO: 5 - DNA, 101 bp, Artificial Sequence
  Synthetic construct
ggctgtaagcggatgccatagttttagtactctggaaacagaatctactaaaacaaggcaaaatgccgtgtttatctcgtcaacttgttggcgagattttt

SEQ ID NO: 6 - DNA, 102 bp, Artificial Sequence
  Synthetic construct
ggctgtaagcggatgccatatgttttagtactctggaaacagaatctactaaaacaaggcaaaatgccgtgtttatctcgtcaacttgttggcgagattttt

SEQ ID NO: 7 - DNA, 103 bp, Artificial Sequence
  Synthetic construct
ggctgtaagcggatgccatatggttttagtactctggaaacagaatctactaaaacaaggcaaaatgccgtgtttatctcgtcaacttgttggcgagattttt

SEQ ID NO: 8 - DNA, 104 bp, Artificial Sequence
  Synthetic construct
ggctgtaagcggatgccatatgggttttagtactctggaaacagaatctactaaaacaaggcaaaatgccgtgtttatctcgtcaacttgttggcgagattttt

SEQ ID NO: 9 - DNA, 105 bp, Artificial Sequence
  Synthetic construct
ggctgtaagcggatgccatatggtgttttagtactctggaaacagaatctactaaaacaaggcaaaatgccgtgtttatctcgtcaacttgttggcgagattttt

SEQ ID NO: 10 - DNA, 106 bp, Artificial Sequence
  Synthetic construct
ggctgtaagcggatgccatatggttgttttagtactctggaaacagaatctactaaaacaaggcaaaatgccgtgtttatctcgtcaacttgttggcgagattttt

SEQ ID NO: 11 - DNA, 107 bp, Artificial Sequence
  Synthetic construct
ggcuguaagcggaugccauaugguugguuuuaguacucuggaaacagaaucuacuaaaacaaggcaaaaugccguguuuaucucgucaacuuguuggcgagauuuuu

SEQ ID NO: 12 - DNA, 47 bp, Artificial Sequence
  Synthetic construct
gggcagcauucaaccauauggcauccgcuuacagccaagcugugacc

SEQ ID NO: 13 - DNA, 47 bp, Artificial Sequence; identical to SEQ ID NO: 12
  Synthetic construct

SEQ ID NO: 14 - DNA, 47 bp, Artificial Sequence
  Synthetic construct
ggucacagcuuggcuguaagcggaugccauaugguugaaugcugccc

SEQ ID NO: 15 - DNA, 47 bp, Artificial Sequence
  Synthetic construct
gggcagcattcaaccatatggcatccgcttacagccaagctgtgacc

SEQ ID NO: 16 - DNA, 47 bp, Artificial Sequence; identical to SEQ ID NO: 15
  Synthetic construct

SEQ ID NO: 17 - DNA, 47 bp, Artificial Sequence
  Synthetic construct
ggtcacagcttggctgtaagcggatgccatatggttgaatgctgccc

SEQ ID NO: 18 - DNA, 21 bp, Artificial Sequence
  Synthetic construct
ccatatggttgaatgctgccc

SEQ ID NO: 19 - DNA, 21 bp, Artificial Sequence
  Synthetic construct
gaagccctgaaagacgcgcag

SEQ ID NO: 20 - DNA, 47 bp, Artificial Sequence; identical to SEQ ID NO: 14
  Synthetic construct

SEQ ID NO: 21 - DNA, 47 bp, Artificial Sequence
  Synthetic construct
gggcagccaagucccauauggcauccgcuuacagccaagcugugacc

SEQ ID NO: 22 - DNA, 47 bp, Artificial Sequence; identical to SEQ ID NO: 21
  Synthetic construct

SEQ ID NO: 23 - DNA, 47 bp, Artificial Sequence; identical to SEQ ID NO: 14
  Synthetic construct

SEQ ID NO: 24 - DNA, 47 bp, Artificial Sequence
  Synthetic construct
ggucacagcuuggcuguaagcggaugccauauaauugaaugcugccc

SEQ ID NO: 25 - DNA, 47 bp, Artificial Sequence
  Synthetic construct
ggucacagcuuggcuguaagcggaugccuauaaauugaaugcugccc

SEQ ID NO: 26 - DNA, 47 bp, Artificial Sequence
  Synthetic construct
ggucacagcuuggcuguaagcguuacaguauaaauugaaugcugccc

SEQ ID NO: 27 - DNA, 47 bp, Artificial Sequence
  Synthetic construct
ggucacagcuuaaugaauucaauuacaguauaaauugaaugcugccc

SEQ ID NO: 28 - DNA, 47 bp, Artificial Sequence
  Synthetic construct
ggucacagcuuaacuguaagcggaugccauaugguugaaugcugccc

SEQ ID NO: 29 - DNA, 47 bp, Artificial Sequence
  Synthetic construct
ggucacagcuuaaugaaaagcggaugccauaugguugaaugcugccc

SEQ ID NO: 30 - DNA, 47 bp, Artificial Sequence
  Synthetic construct
ggucacagcuuaaugaauucaauaugccauaugguugaaugcugccc

SEQ ID NO: 31 - DNA, 47 bp, Artificial Sequence; identical to SEQ ID NO: 12
  Synthetic construct

SEQ ID NO: 32 - DNA, 38 bp, Artificial Sequence
  Synthetic construct
gggauucaaccauauggcauccgcuuacagccaagcug

SEQ ID NO: 33 - DNA, 43 bp, Artificial Sequence
  Synthetic construct
ggguuuuauuuuggauuuggaaacgagaguuucuggucaugaa

SEQ ID NO: 34 - DNA, 47 bp, Artificial Sequence
  Synthetic construct
gggcagctgtcccccatatggcatccgcttacagccaagctgtgacc

SEQ ID NO: 35 - DNA, 47 bp, Artificial Sequence
  Synthetic construct
ggtcacagcttggctgtaagcggatgccatatgggggacagctgccc

SEQ ID NO: 36 - DNA, 47 bp, Artificial Sequence
  Synthetic construct
gggcagcctgtccccatatggcatccgcttacagccaagctgtgacc

SEQ ID NO: 37 - DNA, 47 bp, Artificial Sequence
  Synthetic construct
ggtcacagcttggctgtaagcggatgccatatggggacaggctgccc

SEQ ID NO: 38 - DNA, 47 bp, Artificial Sequence
  Synthetic construct
gggcagctatttgccatatggcatccgcttacagccaagctgtgacc

SEQ ID NO: 39 - DNA, 47 bp, Artificial Sequence
  Synthetic construct
ggtcacagcttggctgtaagcggatgccatatggcaaatagctgccc

SEQ ID NO: 40 - DNA, 104 bp, Artificial Sequence
  Synthetic construct
uagacgagcccaccgcuuagacguuuuaguacucuggaaacagaaucuacuaaaacaaggcaaaaugccguguuuaucucgucaacuuguuggcgagauuuuuu

SEQ ID NO: 41 - DNA, 105 bp, Artificial Sequence
  Synthetic construct
aucccggguccucucuuuaggggguuuuaguacucuggaaacagaaucuacuaaaacaaggcaaaaugccguguuuaucucgucaacuuguuggcgagauuuuuu

SEQ ID NO: 42 - DNA, 105 bp, Artificial Sequence
  Synthetic construct
gugcuugucccccagggucguauguuuuaguacucuggaaacagaaucuacuaaaacaaggcaaaaugccguguuuaucucgucaacuuguuggcgagauuuuuu

SEQ ID NO: 43 - DNA, 104 bp, Artificial Sequence
  Synthetic construct
gagaaucccggguccucucuuuguuuuaguacucuggaaacagaaucuacuaaaacaaggcaaaaugccguguuuaucucgucaacuuguuggcgagauuuuuu

SEQ ID NO: 44 - DNA, 104 bp, Artificial Sequence
  Synthetic construct
gacucugcuugcuggcacuacuguuuuaguacucuggaaacagaaucuacuaaaacaaggcaaaaugccguguuuaucucgucaacuuguuggcgagauuuuuu

SEQ ID NO: 45 - DNA, 105 bp, Artificial Sequence
  Synthetic construct
acuucgcuuguaggcaccuugauguuuuaguacucuggaaacagaaucuacuaaaacaaggcaaaaugccguguuuaucucgucaacuuguuggcgagauuuuuu

SEQ ID NO: 46 - DNA, 104 bp, Artificial Sequence
  Synthetic construct
auucauaucaggcuccuuacagguuuuaguacucuggaaacagaaucuacuaaaacaaggcaaaaugccguguuuaucucgucaacuuguuggcgagauuuuuu

SEQ ID NO: 47 - DNA, 103 bp, Artificial Sequence
  Synthetic construct
gaggucccugggccgaagcccguuuuaguacucuggaaacagaaucuacuaaaacaaggcaaaaugccguguuuaucucgucaacuuguuggcgagauuuuuu

SEQ ID NO: 48 - DNA, 102 bp, Artificial Sequence
  Synthetic construct
uucgauguaagucaaguuuuguuuuaguacucuggaaacagaaucuacuaaaacaaggcaaaaugccguguuuaucucgucaacuuguuggcgagauuuuuu

SEQ ID NO: 49 - DNA, 105 bp, Artificial Sequence
  Synthetic construct
uauaccgcuuucaguuuucauuuguuuuaguacucuggaaacagaaucuacuaaaacaaggcaaaaugccguguuuaucucgucaacuuguuggcgagauuuuuu

SEQ ID NO: 50 - DNA, 105 bp, Artificial Sequence
  Synthetic construct
guucuauucuucauuucguuacaguuuuaguacucuggaaacagaaucuacuaaaacaaggcaaaaugccguguuuaucucgucaacuuguuggcgagauuuuuu

SEQ ID NO: 51 - DNA, 104 bp, Artificial Sequence
  Synthetic construct
uacggaccggucucagggaauuguuuuaguacucuggaaacagaaucuacuaaaacaaggcaaaaugccguguuuaucucgucaacuuguuggcgagauuuuuu

SEQ ID NO: 52 - DNA, 104 bp, Artificial Sequence
  Synthetic construct
ggcaugcgacguggaacucuauguuuuaguacucuggaaacagaaucuacuaaaacaaggcaaaaugccguguuuaucucgucaacuuguuggcgagauuuuuu

SEQ ID NO: 53 - DNA, 105 bp, Artificial Sequence
  Synthetic construct
caugguaccuuucuccucuuuaaguuuuaguacucuggaaacagaaucuacuaaaacaaggcaaaaugccguguuuaucucgucaacuuguuggcgagauuuuuu

SEQ ID NO: 54 - DNA, 105 bp, Artificial Sequence
  Synthetic construct
ccagugaaaaguucuucuccuuuguuuuaguacucuggaaacagaaucuacuaaaacaaggcaaaaugccguguuuaucucgucaacuuguuggcgagauuuuuu

SEQ ID NO: 55 - DNA, 105 bp, Artificial Sequence
  Synthetic construct
caccaucuaauucaacaagaauuguuuuaguacucuggaaacagaaucuacuaaaacaaggcaaaaugccguguuuaucucgucaacuuguuggcgagauuuuuu

SEQ ID NO: 56 - DNA, 105 bp, Artificial Sequence
  Synthetic construct
cagaaaauuugugcccauuaacaguuuuaguacucuggaaacagaaucuacuaaaacaaggcaaaaugccguguuuaucucgucaacuuguuggcgagauuuuuu

SEQ ID NO: 57 - DNA, 105 bp, Artificial Sequence
  Synthetic construct
agcaucaccuucacccucuccacguuuuaguacucuggaaacagaaucuacuaaaacaaggcaaaaugccguguuuaucucgucaacuuguuggcgagauuuuuu

SEQ ID NO: 58 - DNA, 105 bp, Artificial Sequence
  Synthetic construct
aauuuaagggugaguuuuccguuguuuuaguacucuggaaacagaaucuacuaaaacaaggcaaaaugccguguuuaucucgucaacuuguuggcgagauuuuuu

SEQ ID NO: 59 - DNA, 105 bp, Artificial Sequence
  Synthetic construct
gaacagguaguuuuccaguagugguuuuaguacucuggaaacagaaucuacuaaaacaaggcaaaaugccguguuuaucucgucaacuuguuggcgagauuuuuu

SEQ ID NO: 60 - DNA, 105 bp, Artificial Sequence
  Synthetic construct
cgggcauggcacucuugaaaaagguuuuaguacucuggaaacagaaucuacuaaaacaaggcaaaaugccguguuuaucucgucaacuuguuggcgagauuuuuu

SEQ ID NO: 61 - DNA, 105 bp, Artificial Sequence
  Synthetic construct
aaagauauagugcguuccuguacguuuuaguacucuggaaacagaaucuacuaaaacaaggcaaaaugccguguuuaucucgucaacuuguuggcgagauuuuuu

SEQ ID NO: 62 - DNA, 105 bp, Artificial Sequence
  Synthetic construct
acgcgucuuguaggucccgucauguuuuaguacucuggaaacagaaucuacuaaaacaaggcaaaaugccguguuuaucucgucaacuuguuggcgagauuuuuu

SEQ ID NO: 63 - DNA, 105 bp, Artificial Sequence
  Synthetic construct
uuuaaaaucaauacccuuuaacuguuuuaguacucuggaaacagaaucuacuaaaacaaggcaaaaugccguguuuaucucgucaacuuguuggcgagauuuuuu

SEQ ID NO: 64 - DNA, 105 bp, Artificial Sequence
  Synthetic construct
guugaacggaaccaucuucaacgguuuuaguacucuggaaacagaaucuacuaaaacaaggcaaaaugccguguuuaucucgucaacuuguuggcgagauuuuuu

SEQ ID NO: 65 - DNA, 105 bp, Artificial Sequence
  Synthetic construct
auguguaaucccagcagcaguuaguuuuaguacucuggaaacagaaucuacuaaaacaaggcaaaaugccguguuuaucucgucaacuuguuggcgagauuuuuu

SEQ ID NO: 66 - DNA, 105 bp, Artificial Sequence; identical to SEQ ID NO: 55
  Synthetic construct

SEQ ID NO: 67 - DNA, 104 bp, Artificial Sequence
  Synthetic construct
caccaucuaauucaacaagaauguuuuaguacucuggaaacagaaucuacuaaaacaaggcaaaaugccguguuuaucucgucaacuuguuggcgagauuuuuu

SEQ ID NO: 68 - DNA, 103 bp, Artificial Sequence
  Synthetic construct
caccaucuaauucaacaagaaguuuuaguacucuggaaacagaaucuacuaaaacaaggcaaaaugccguguuuaucucgucaacuuguuggcgagauuuuuu

SEQ ID NO: 69 - DNA, 102 bp, Artificial Sequence
  Synthetic construct
caccaucuaauucaacaagaguuuuaguacucuggaaacagaaucuacuaaaacaaggcaaaaugccguguuuaucucgucaacuuguuggcgagauuuuuu

SEQ ID NO: 70 - DNA, 105 bp, Artificial Sequence
  Synthetic construct
aauucuuguugaauuagauggugguuuuaguacucuggaaacagaaucuacuaaaacaaggcaaaaugccguguuuaucucgucaacuuguuggcgagauuuuuu

SEQ ID NO: 71 - DNA, 105 bp, Artificial Sequence
  Synthetic construct
cacuacuggaaaacuaccuguucguuuuaguacucuggaaacagaaucuacuaaaacaaggcaaaaugccguguuuaucucgucaacuuguuggcgagauuuuuu

SEQ ID NO: 72 - DNA, 24 bp, Artificial Sequence
  Synthetic construct
aattcttgttgaattagatggtga

SEQ ID NO: 73 - DNA, 23 bp, Artificial Sequence
  Synthetic construct
cactactggaaaactacctgttc

SEQ ID NO: 74 - DNA, 23 bp, Artificial Sequence
  Synthetic construct
acctatggtgttcaatgcttttc

SEQ ID NO: 75 - DNA, 23 bp, Artificial Sequence
  Synthetic construct
attggcgatggccctgtcctttt

SEQ ID NO: 76 - DNA, 714 bp, Artificial Sequence
  Synthetic construct
atgagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaa

SEQ ID NO: 77-99 - skipped (23 entries)

SEQ ID NO: 100 - protein, 1054 aa, Staphylococcus aureus
MGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 101 - protein, 1054 aa, Artificial Sequence
  Synthetic construct
MGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 102 - protein, 1368 aa, Streptococcus pyogenes [sequence omitted]

SEQ ID NO: 103 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 104 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 105-109 - skipped (5 entries)

SEQ ID NO: 110 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 111 - protein, 984 aa, Campylobacter jejuni; identical to SEQ ID NO: 104

SEQ ID NO: 112 - protein, 1409 aa, Streptococcus thermophilus
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 113 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 114 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 115 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 116 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 117 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 118 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 119 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 120 - protein, 1377 aa, Streptococcus pasteurianus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKADEIKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYNEDLEELLGKIGDDYADLFTSAKNLYDAILLSGILTVDDNSTKAPLSASMIKRYAEHHEDLEKLKEFIKANKSELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDVHKLIAKSSDDHSEMGKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 121 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 122-149 - skipped (28 entries)

SEQ ID NO: 150 - DNA, 36 bp, Artificial Sequence
  Synthetic construct
gttttagtactctgtaattttaggtatgaggtagac

SEQ ID NO: 151 - DNA, 36 bp, Artificial Sequence
  Synthetic construct
guuuuaguacucuguaauuuuagguaugagguagac

SEQ ID NO: 152 - DNA, 14 bp, Artificial Sequence
  Synthetic construct
gttttagtactctg

SEQ ID NO: 153 - DNA, 14 bp, Artificial Sequence
  Synthetic construct
guuuuaguacucug

SEQ ID NO: 154 - DNA, 13 bp, Artificial Sequence
  Synthetic construct
gttttagtactct

SEQ ID NO: 155 - DNA, 13 bp, Artificial Sequence
  Synthetic construct
guuuuaguacucu

SEQ ID NO: 156 - DNA, 6 bp, Artificial Sequence
  Synthetic construct
ggaaac

SEQ ID NO: 157 - DNA, 5 bp, Artificial Sequence
  Synthetic construct
ggaaa

SEQ ID NO: 158 - DNA, 4 bp, Artificial Sequence
  Synthetic construct
gaaa

SEQ ID NO: 159 - DNA, 4 bp, Artificial Sequence
  Synthetic construct
tgaa

SEQ ID NO: 160 - DNA, 4 bp, Artificial Sequence
  Synthetic construct
ugaa

SEQ ID NO: 161 - DNA, 3 bp, Artificial Sequence
  Synthetic construct
aaa

SEQ ID NO: 162 - DNA, 85 bp, Artificial Sequence
  Synthetic construct
attgtacttatacctaaaattacagaatctactaaaacaaggcaaaatgccgtgtttatctcgtcaacttgttggcgagattttt

SEQ ID NO: 163 - DNA, 85 bp, Artificial Sequence
  Synthetic construct
auuguacuuauaccuaaaauuacagaaucuacuaaaacaaggcaaaaugccguguuuaucucgucaacuuguuggcgagauuuuu

SEQ ID NO: 164 - DNA, 64 bp, Artificial Sequence
  Synthetic construct
acagaatctactaaaacaaggcaaaatgccgtgtttatctcgtcaacttgttggcgagattttt

SEQ ID NO: 165 - DNA, 64 bp, Artificial Sequence
  Synthetic construct
acagaaucuacuaaaacaaggcaaaaugccguguuuaucucgucaacuuguuggcgagauuuuu

SEQ ID NO: 166 - DNA, 64 bp, Artificial Sequence; identical to SEQ ID NO: 164
  Synthetic construct

SEQ ID NO: 167 - DNA, 63 bp, Artificial Sequence
  Synthetic construct
acagaatctactaaaacaaggcaaaatgccgtgtttatctcgtcaacttgttggcgagatttt

SEQ ID NO: 168 - DNA, 62 bp, Artificial Sequence
  Synthetic construct
acagaatctactaaaacaaggcaaaatgccgtgtttatctcgtcaacttgttggcgagattt

SEQ ID NO: 169 - DNA, 61 bp, Artificial Sequence
  Synthetic construct
acagaatctactaaaacaaggcaaaatgccgtgtttatctcgtcaacttgttggcgagatt

SEQ ID NO: 170 - DNA, 60 bp, Artificial Sequence
  Synthetic construct
acagaatctactaaaacaaggcaaaatgccgtgtttatctcgtcaacttgttggcgagat

SEQ ID NO: 171 - DNA, 63 bp, Artificial Sequence
  Synthetic construct
cagaatctactaaaacaaggcaaaatgccgtgtttatctcgtcaacttgttggcgagattttt

SEQ ID NO: 172 - DNA, 63 bp, Artificial Sequence
  Synthetic construct
cagaaucuacuaaaacaaggcaaaaugccguguuuaucucgucaacuuguuggcgagauuuuu

SEQ ID NO: 173 - DNA, 62 bp, Artificial Sequence
  Synthetic construct
cagaatctactaaaacaaggcaaaatgccgtgtttatctcgtcaacttgttggcgagatttt

SEQ ID NO: 174 - DNA, 61 bp, Artificial Sequence
  Synthetic construct
cagaatctactaaaacaaggcaaaatgccgtgtttatctcgtcaacttgttggcgagattt

SEQ ID NO: 175 - DNA, 60 bp, Artificial Sequence
  Synthetic construct
cagaatctactaaaacaaggcaaaatgccgtgtttatctcgtcaacttgttggcgagatt

SEQ ID NO: 176 - DNA, 59 bp, Artificial Sequence
  Synthetic construct
cagaatctactaaaacaaggcaaaatgccgtgtttatctcgtcaacttgttggcgagat

SEQ ID NO: 177 - DNA, 30 bp, Artificial Sequence
  Synthetic construct
cagaatctactaaaacaaggcaaaatgccg

SEQ ID NO: 178 - DNA, 29 bp, Artificial Sequence
  Synthetic construct
cagaatctactaaaacaaggcaaaatgcc

SEQ ID NO: 179 - DNA, 35 bp, Artificial Sequence
  Synthetic construct
guuuuagucccuuuuuaaauuucuuuaugguaaau

SEQ ID NO: 180 - DNA, 35 bp, Artificial Sequence
  Synthetic construct
gttttagtccctttttaaatttctttatggtaaat

SEQ ID NO: 181 - DNA, 13 bp, Artificial Sequence
  Synthetic construct
gttttagtccctt

SEQ ID NO: 182 - DNA, 13 bp, Artificial Sequence
  Synthetic construct
guuuuagucccuu

SEQ ID NO: 183 - DNA, 12 bp, Artificial Sequence
  Synthetic construct
gttttagtccct

SEQ ID NO: 184 - DNA, 12 bp, Artificial Sequence
  Synthetic construct
guuuuagucccu

SEQ ID NO: 185 - DNA, 11 bp, Artificial Sequence
  Synthetic construct
gttttagtccc

SEQ ID NO: 186 - DNA, 11 bp, Artificial Sequence
  Synthetic construct
guuuuaguccc

SEQ ID NO: 187 - DNA, 4 bp, Artificial Sequence
  Synthetic construct
gaaa

SEQ ID NO: 188 - DNA, 4 bp, Artificial Sequence
  Synthetic construct
tgaa

SEQ ID NO: 189 - DNA, 4 bp, Artificial Sequence
  Synthetic construct
ugaa

SEQ ID NO: 190 - DNA, 8 bp, Artificial Sequence
  Synthetic construct
atattcaa

SEQ ID NO: 191 - DNA, 12 bp, Artificial Sequence
  Synthetic construct
tgtggaaatata

SEQ ID NO: 192 - DNA, 74 bp, Artificial Sequence
  Synthetic construct
aagaaatttaaaaagggactaaaataaagagtttgcgggactctgcggggttacaatcccctaaaaccgctttt

SEQ ID NO: 193 - DNA, 74 bp, Artificial Sequence
  Synthetic construct
aagaaauuuaaaaagggacuaaaauaaagaguuugcgggacucugcgggguuacaauccccuaaaaccgcuuuu

SEQ ID NO: 194 - DNA, 64 bp, Artificial Sequence
  Synthetic construct
agggactaaaataaagagtttgcgggactctgcggggttacaatcccctaaaaccgcttttttt

SEQ ID NO: 195 - DNA, 64 bp, Artificial Sequence
  Synthetic construct
agggacuaaaauaaagaguuugcgggacucugcgggguuacaauccccuaaaaccgcuuuuuuu

SEQ ID NO: 196 - DNA, 63 bp, Artificial Sequence
  Synthetic construct
agggactaaaataaagagtttgcgggactctgcggggttacaatcccctaaaaccgctttttt

SEQ ID NO: 197 - DNA, 62 bp, Artificial Sequence
  Synthetic construct
agggactaaaataaagagtttgcgggactctgcggggttacaatcccctaaaaccgcttttt

SEQ ID NO: 198 - DNA, 61 bp, Artificial Sequence
  Synthetic construct
agggactaaaataaagagtttgcgggactctgcggggttacaatcccctaaaaccgctttt

SEQ ID NO: 199 - DNA, 60 bp, Artificial Sequence
  Synthetic construct
agggactaaaataaagagtttgcgggactctgcggggttacaatcccctaaaaccgcttt

SEQ ID NO: 200 - DNA, 59 bp, Artificial Sequence
  Synthetic construct
agggactaaaataaagagtttgcgggactctgcggggttacaatcccctaaaaccgctt

SEQ ID NO: 201 - DNA, 58 bp, Artificial Sequence
  Synthetic construct
agggactaaaataaagagtttgcgggactctgcggggttacaatcccctaaaaccgct

SEQ ID NO: 202 - DNA, 57 bp, Artificial Sequence
  Synthetic construct
agggactaaaataaagagtttgcgggactctgcggggttacaatcccctaaaaccgc

SEQ ID NO: 203 - DNA, 63 bp, Artificial Sequence
  Synthetic construct
gggactaaaataaagagtttgcgggactctgcggggttacaatcccctaaaaccgcttttttt

SEQ ID NO: 204 - DNA, 63 bp, Artificial Sequence
  Synthetic construct
gggacuaaaauaaagaguuugcgggacucugcgggguuacaauccccuaaaaccgcuuuuuuu

SEQ ID NO: 205 - DNA, 62 bp, Artificial Sequence
  Synthetic construct
gggactaaaataaagagtttgcgggactctgcggggttacaatcccctaaaaccgctttttt

SEQ ID NO: 206 - DNA, 61 bp, Artificial Sequence
  Synthetic construct
gggactaaaataaagagtttgcgggactctgcggggttacaatcccctaaaaccgcttttt

SEQ ID NO: 207 - DNA, 60 bp, Artificial Sequence
  Synthetic construct
gggactaaaataaagagtttgcgggactctgcggggttacaatcccctaaaaccgctttt

SEQ ID NO: 208 - DNA, 59 bp, Artificial Sequence
  Synthetic construct
gggactaaaataaagagtttgcgggactctgcggggttacaatcccctaaaaccgcttt

SEQ ID NO: 209 - DNA, 58 bp, Artificial Sequence
  Synthetic construct
gggactaaaataaagagtttgcgggactctgcggggttacaatcccctaaaaccgctt

SEQ ID NO: 210 - DNA, 57 bp, Artificial Sequence
  Synthetic construct
gggactaaaataaagagtttgcgggactctgcggggttacaatcccctaaaaccgct

SEQ ID NO: 211 - DNA, 56 bp, Artificial Sequence
  Synthetic construct
gggactaaaataaagagtttgcgggactctgcggggttacaatcccctaaaaccgc

SEQ ID NO: 212 - DNA, 30 bp, Artificial Sequence
  Synthetic construct
gggactaaaataaagagtttgcgggactct

SEQ ID NO: 213 - DNA, 36 bp, Artificial Sequence
  Synthetic construct
gtttttgtactctcaagatttaagtaactgtacaac

SEQ ID NO: 214 - DNA, 36 bp, Artificial Sequence
  Synthetic construct
gttttagagctgtgttgtttcgaatggttccaaaac

SEQ ID NO: 215 - DNA, 36 bp, Artificial Sequence
  Synthetic construct
ggtttgaaaccattcgaaacaacacagcgagttaaa

SEQ ID NO: 216 - DNA, 36 bp, Artificial Sequence
  Synthetic construct
cttacacagttacttaaatcttgcagaagctacaaa

SEQ ID NO: 217 - DNA, 27 bp, Artificial Sequence
  Synthetic construct
gtttttgtactctcaagatttaagtaa

SEQ ID NO: 218 - DNA, 18 bp, Artificial Sequence
  Synthetic construct
gtttttgtactctcaaga

SEQ ID NO: 219 - DNA, 17 bp, Artificial Sequence
  Synthetic construct
gtttttgtactctcaag

SEQ ID NO: 220 - DNA, 27 bp, Artificial Sequence
  Synthetic construct
gttttagagctgtgttgtttcgaatgg

SEQ ID NO: 221 - DNA, 17 bp, Artificial Sequence
  Synthetic construct
gttttagagctgtgttg

SEQ ID NO: 222 - DNA, 17 bp, Artificial Sequence
  Synthetic construct
ggtttgaaaccattcga

SEQ ID NO: 223 - DNA, 16 bp, Artificial Sequence
  Synthetic construct
ggtttgaaaccattcg

SEQ ID NO: 224 - DNA, 17 bp, Artificial Sequence
  Synthetic construct
cttacacagttacttaa

SEQ ID NO: 225 - DNA, 15 bp, Artificial Sequence
  Synthetic construct
cttacacagttactt

SEQ ID NO: 226 - DNA, 4 bp, Artificial Sequence
  Synthetic construct
gaaa

SEQ ID NO: 227 - DNA, 4 bp, Artificial Sequence
  Synthetic construct
taaa

SEQ ID NO: 228 - DNA, 4 bp, Artificial Sequence
  Synthetic construct
attt

SEQ ID NO: 229 - DNA, 4 bp, Artificial Sequence
  Synthetic construct
gttt

SEQ ID NO: 230 - DNA, 3 bp, Artificial Sequence
  Synthetic construct
ttt

SEQ ID NO: 231 - DNA, 3 bp, Artificial Sequence
  Synthetic construct
aaa

SEQ ID NO: 232 - DNA, 90 bp, Artificial Sequence
  Synthetic construct
ttacttaaatcttgcagaagctacaaagataaggcttcatgccgaaatcaacaccctgtcattttatggcagggtgttttcgttatttaa

SEQ ID NO: 233 - DNA, 104 bp, Artificial Sequence
  Synthetic construct
gtaaggggcgccttacacagttacttaaatcttgcagaagctacaaagataaggcttcatgccgaaatcaacaccctgtcattttatggcagggtgttttcgtt

SEQ ID NO: 234 - DNA, 93 bp, Artificial Sequence
  Synthetic construct
cttacacagttacttaaatcttgcagaagctacaaagataaggcttcatgccgaaatcaacaccctgtcattttatggcagggtgttttcgtt

SEQ ID NO: 235 - DNA, 36 bp, Artificial Sequence; identical to SEQ ID NO: 216
  Synthetic construct

SEQ ID NO: 236 - DNA, 96 bp, Artificial Sequence
  Synthetic construct
ttgtggtttgaaaccattcgaaacaacacagcgagttaaaataaggcttagtccgtactcaacttgaaaaggtggcaccgattcggtgtttttttt

SEQ ID NO: 237 - DNA, 92 bp, Artificial Sequence
  Synthetic construct
ggtttgaaaccattcgaaacaacacagcgagttaaaataaggcttagtccgtactcaacttgaaaaggtggcaccgattcggtgtttttttt

SEQ ID NO: 238 - DNA, 36 bp, Artificial Sequence; identical to SEQ ID NO: 215
  Synthetic construct

SEQ ID NO: 239 - DNA, 37 bp, Artificial Sequence
  Synthetic construct
gcaacactttatagcaaatccgcttagcctgtgaaac

SEQ ID NO: 240 - DNA, 36 bp, Artificial Sequence
  Synthetic construct
attatagcgaggaatggctgagtaggcggctataac

SEQ ID NO: 241 - DNA, 24 bp, Artificial Sequence
  Synthetic construct
gcaacactttatagcaaatccgct

SEQ ID NO: 242 - DNA, 15 bp, Artificial Sequence
  Synthetic construct
gcaacactttatagc

SEQ ID NO: 243 - DNA, 11 bp, Artificial Sequence
  Synthetic construct
gcaacacttta

SEQ ID NO: 244 - DNA, 37 bp, Artificial Sequence
  Synthetic construct
tttcaaggcatcgaacggatttgctataaagtgttgc

SEQ ID NO: 245 - DNA, 37 bp, Artificial Sequence
  Synthetic construct
tttgttaaagctggatgggattattatagagtgttgc

SEQ ID NO: 246 - DNA, 36 bp, Artificial Sequence
  Synthetic construct
atagccgctgcctactcagccatttagcgcagcgac

SEQ ID NO: 247 - DNA, 13 bp, Artificial Sequence
  Synthetic construct
tatagagtgttgc

SEQ ID NO: 248 - DNA, 11 bp, Artificial Sequence
  Synthetic construct
tagagugttgc

SEQ ID NO: 249 - DNA, 13 bp, Artificial Sequence
  Synthetic construct
tataaagtgttgc

SEQ ID NO: 250 - DNA, 11 bp, Artificial Sequence
  Synthetic construct
taaagtgttgc

SEQ ID NO: 251 - DNA, 36 bp, Artificial Sequence
  Synthetic construct
gttttagtactctgtaattttaggtataagtgatac

SEQ ID NO: 252 - DNA, 35 bp, Artificial Sequence
  Synthetic construct
ttttagtactctgtaattttaggtataagtgatac

SEQ ID NO: 253 - DNA, 21 bp, Artificial Sequence
  Synthetic construct
tctgtaattttaggtataagt

SEQ ID NO: 254 - DNA, 36 bp, Artificial Sequence
  Synthetic construct
cttgtacttatacctaaaattacagaatctactgaa

SEQ ID NO: 255 - DNA, 21 bp, Artificial Sequence
  Synthetic construct
acttatacctaaaattacaga

SEQ ID NO: 256 - DNA, 36 bp, Artificial Sequence
  Synthetic construct
gttttagcactatgtttatttagaaagaggtaaaac

SEQ ID NO: 257 - DNA, 28 bp, Artificial Sequence
  Synthetic construct
actatgtttatttagaaagaggtaaaac

SEQ ID NO: 258 - DNA, 36 bp, Artificial Sequence
  Synthetic construct
gttttacttctttctaaataaacatagttaagttaa

SEQ ID NO: 259 - DNA, 28 bp, Artificial Sequence
  Synthetic construct
gttttacttctttctaaataaacatagt

SEQ ID NO: 260 - DNA, 36 bp, Artificial Sequence
  Synthetic construct
attttagcataaacatatttatgaagtggctaaaac

SEQ ID NO: 261 - DNA, 36 bp, Artificial Sequence
  Synthetic construct
gtatttgtcaataaatatactttataatggcaagat

SEQ ID NO: 262 - DNA, 27 bp, Artificial Sequence
  Synthetic construct
gtttttgtactctcaagatttaagtaa

SEQ ID NO: 263 - DNA, 18 bp, Artificial Sequence
  Synthetic construct
gtttttgtactctcaaga

SEQ ID NO: 264 - DNA, 17 bp, Artificial Sequence
  Synthetic construct
gtttttgtactctcaag

SEQ ID NO: 265 - DNA, 4 bp, Artificial Sequence
  Synthetic construct
ttaa

SEQ ID NO: 266 - DNA, 4 bp, Artificial Sequence
  Synthetic construct
taaa

SEQ ID NO: 267 - DNA, 3 bp, Artificial Sequence
  Synthetic construct
ttt

SEQ ID NO: 268 - DNA, 3 bp, Artificial Sequence
  Synthetic construct
tta

SEQ ID NO: 269 - DNA, 3 bp, Artificial Sequence
  Synthetic construct
aaa

SEQ ID NO: 270 - DNA, 81 bp, Artificial Sequence
  Synthetic construct
ttacttaaatcttgctgagcctacaaagataaggctttatgccgaattcaagcaccccatgttttgacatgaggtgctttt

SEQ ID NO: 271 - DNA, 72 bp, Artificial Sequence
  Synthetic construct
tcttgctgagcctacaaagataaggctttatgccgaattcaagcaccccatgttttgacatgaggtgctttt

SEQ ID NO: 272 - DNA, 71 bp, Artificial Sequence
  Synthetic construct
cttgctgagcctacaaagataaggctttatgccgaattcaagcaccccatgttttgacatgaggtgctttt

SEQ ID NO: 273 - DNA, 34 bp, Artificial Sequence
  Synthetic construct
tcttgctgagcctacaaagataaggctttatgcc

SEQ ID NO: 274 - DNA, 83 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nnguuuuaguacucuggaaacagaaucuacuaaaacaaggcaaaaugccguguuuaucucgucaacuuguuggcgagauuuuu

SEQ ID NO: 275 - DNA, 83 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtactctggaaacagaatctactaaaacaaggcaaaatgccgtgtttatctcgtcaacttgttggcgagattttt

SEQ ID NO: 276 - DNA, 81 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nnguuuuaguacucuggaaacagaaucuacuaaaacaaggcaaaaugccguguuuaucucgucaacuuguuggcgagauuu

SEQ ID NO: 277 - DNA, 81 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtactctggaaacagaatctactaaaacaaggcaaaatgccgtgtttatctcgtcaacttgttggcgagattt

SEQ ID NO: 278 - DNA, 75 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtccctgaaaagggactaaaataaagagtttgcgggactctgcggggttacaatcccctaaaaccgc

SEQ ID NO: 279 - DNA, 75 bp, Artificial Sequence; identical to SEQ ID NO: 278
  Synthetic construct
  misc_feature (1)..(1): any nucleotide or nucleic acid, including any sequence for W described herein
  misc_feature (2)..(2): any nucleotide or nucleic acid, including any sequence for X described herein

SEQ ID NO: 280 - DNA, 75 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nnguuuuagucccugaaaagggacuaaaauaaagaguuugcgggacucugcgggguuacaauccccuaaaaccgc

SEQ ID NO: 281 - DNA, 81 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtccctgaaaagggactaaaataaagagtttgcgggactctgcggggttacaatcccctaaaaccgctttttt

SEQ ID NO: 282 - DNA, 82 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtccctgaaaagggactaaaataaagagtttgcgggactctgcggggttacaatcccctaaaaccgcttttttt

SEQ ID NO: 283 - DNA, 80 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtccctgaagggactaaaataaaagagtttgcgggactctgcggggttacaatcccctaaaaccgctttttt

SEQ ID NO: 284 - DNA, 90 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtcccttgtggaaatataagggactaaaataaagagtttgcgggactctgcggggttacaatcccctaaaaccgcttttttt

SEQ ID NO: 285 - DNA, 86 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngttttagtccctatattcaaagggactaaaataaagagtttgcgggactctgcggggttacaatcccctaaaaccgcttttttt

SEQ ID NO: 286 - DNA, 96 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagattaatcttgctgagcctacaaagataaggctttatgccgaattcaagcaccccatgttttgacatgaggtgctttt

SEQ ID NO: 287 - DNA, 92 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagattaatcttgctgagcctacaaagataaggctttatgccgaattcaagcaccccatgttttgacatgaggtgc

SEQ ID NO: 288 - DNA, 95 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagataatcttgctgagcctacaaagataaggctttatgccgaattcaagcaccccatgttttgacatgaggtgctttt

SEQ ID NO: 289 - DNA, 91 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagataatcttgctgagcctacaaagataaggctttatgccgaattcaagcaccccatgttttgacatgaggtgc

SEQ ID NO: 290 - DNA, 93 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagaaacttgctgagcctacaaagataaggctttatgccgaattcaagcaccccatgttttgacatgaggtgctttt

SEQ ID NO: 291 - DNA, 89 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagaaacttgctgagcctacaaagataaggctttatgccgaattcaagcaccccatgttttgacatgaggtgc

SEQ ID NO: 292 - DNA, 93 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagaatcttgctgagcctacaaagataaggctttatgccgaattcaagcaccccatgttttgacatgaggtgctttt

SEQ ID NO: 293 - DNA, 89 bp, Artificial Sequence
  Synthetic construct
  misc_feature (1)..(1): any nucleotide or nucleic acid, including any sequence for W described herein
  misc_feature (2)..(2): any nucleotide or nucleic acid, including any sequence for X described herein
nngtttttgtactctcaagaatcttgctgagcctacaaagataaggctttatgccgaattcaagcaccccatgttttgacatgaggtgc

SEQ ID NO: 294-299 - skipped (6 entries)

SEQ ID NO: 300 - DNA, 26 bp, Artificial Sequence
  Synthetic construct
ggcuguaagcggaugccauaugguug

SEQ ID NO: 301 - DNA, 25 bp, Artificial Sequence
  Synthetic construct
ggcuguaagcggaugccauaugguu

SEQ ID NO: 302 - DNA, 24 bp, Artificial Sequence
  Synthetic construct
ggcuguaagcggaugccauauggu

SEQ ID NO: 303 - DNA, 23 bp, Artificial Sequence
  Synthetic construct
ggcuguaagcggaugccauaugg

SEQ ID NO: 304 - DNA, 22 bp, Artificial Sequence
  Synthetic construct
ggcuguaagcggaugccauaug

SEQ ID NO: 305 - DNA, 21 bp, Artificial Sequence
  Synthetic construct
ggcuguaagcggaugccauau

SEQ ID NO: 306 - DNA, 20 bp, Artificial Sequence
  Synthetic construct
ggcuguaagcggaugccaua

SEQ ID NO: 307 - DNA, 47 bp, Artificial Sequence; identical to SEQ ID NO: 12
  Synthetic construct

SEQ ID NO: 308 - DNA, 23 bp, Artificial Sequence
  Synthetic construct
uauaccgcuuucaguuuucauuu

SEQ ID NO: 309 - DNA, 31 bp, Artificial Sequence
  Synthetic construct
aaaguggcaacccagacuguuggugguguag

SEQ ID NO: 310 - DNA, 38 bp, Artificial Sequence
  Synthetic construct
ggcagcauucaaccauauggcauccgcuuacagccaag

SEQ ID NO: 311 - DNA, 23 bp, Artificial Sequence
  Synthetic construct
ccauauggcauccgcuuacagca

SEQ ID NO: 312 - DNA, 23 bp, Artificial Sequence
  Synthetic construct
ccauauggcauccgcuuacagac

SEQ ID NO: 313 - DNA, 23 bp, Artificial Sequence
  Synthetic construct
ccauauggcauccgcuuacaucc

SEQ ID NO: 314 - DNA, 23 bp, Artificial Sequence
  Synthetic construct
ccauauggcauccgcuuaccgcc

SEQ ID NO: 315 - DNA, 23 bp, Artificial Sequence
  Synthetic construct
ccauauggcauccgcuuaaagcc

SEQ ID NO: 316 - DNA, 23 bp, Artificial Sequence
  Synthetic construct
ccauauggcauccgcuuccagcc

SEQ ID NO: 317 - DNA, 23 bp, Artificial Sequence
  Synthetic construct
ccauauggcauccgcugacagcc

SEQ ID NO: 318 - DNA, 23 bp, Artificial Sequence
  Synthetic construct
ccauauggcauccgcguacagcc

SEQ ID NO: 319 - DNA, 23 bp, Artificial Sequence
  Synthetic construct
ccauauggcauccgauuacagcc

SEQ ID NO: 320 - DNA, 23 bp, Artificial Sequence
  Synthetic construct
ccauauggcauccucuuacagcc

SEQ ID NO: 321 - DNA, 23 bp, Artificial Sequence
  Synthetic construct
ccauauggcaucagcuuacagcc

SEQ ID NO: 322 - DNA, 23 bp, Artificial Sequence
  Synthetic construct
ccauauggcauacgcuuacagcc

SEQ ID NO: 323 - DNA, 23 bp, Artificial Sequence
  Synthetic construct
ccauauggcagccgcuuacagcc

SEQ ID NO: 324 - DNA, 23 bp, Artificial Sequence
  Synthetic construct
ccauauggccuccgcuuacagcc

SEQ ID NO: 325 - DNA, 23 bp, Artificial Sequence
  Synthetic construct
ccauauggaauccgcuuacagcc

SEQ ID NO: 326 - DNA, 23 bp, Artificial Sequence
  Synthetic construct
ccauaugucauccgcuuacagcc

SEQ ID NO: 327 - DNA, 22 bp, Artificial Sequence
  Synthetic construct
ccauauucauccgcuuacagcc

SEQ ID NO: 328 - DNA, 22 bp, Artificial Sequence
  Synthetic construct
ccauaggcauccgcuuacagcc

SEQ ID NO: 329 - DNA, 22 bp, Artificial Sequence
  Synthetic construct
ccaucggcauccgcuuacagcc

SEQ ID NO: 330 - DNA, 23 bp, Artificial Sequence
  Synthetic construct
ccagauggcauccgcuuacagcc

SEQ ID NO: 331 - DNA, 23 bp, Artificial Sequence
  Synthetic construct
cccuauggcauccgcuuacagcc

SEQ ID NO: 332 - DNA, 23 bp, Artificial Sequence
  Synthetic construct
caauauggcauccgcuuacagcc

SEQ ID NO: 333 - DNA, 23 bp, Artificial Sequence
  Synthetic construct
acauauggcauccgcuuacagcc

SEQ ID NO: 334 - DNA, 20 bp, Artificial Sequence
  Synthetic construct
tgggtggtaactagccaagc

SEQ ID NO: 335 - DNA, 20 bp, Artificial Sequence
  Synthetic construct
gggtggtaactagccaagca

SEQ ID NO: 336 - DNA, 20 bp, Artificial Sequence
  Synthetic construct
ggtggtaactagccaagcag

SEQ ID NO: 337 - DNA, 20 bp, Artificial Sequence
  Synthetic construct
gtggtaactagccaagcagc

SEQ ID NO: 338 - DNA, 20 bp, Artificial Sequence
  Synthetic construct
tggtaactagccaagcagct

SEQ ID NO: 339 - DNA, 20 bp, Artificial Sequence
  Synthetic construct
ggtaactagccaagcagcta

SEQ ID NO: 340 - DNA, 20 bp, Artificial Sequence
  Synthetic construct
gtaactagccaagcagctag

SEQ ID NO: 341 - DNA, 20 bp, Artificial Sequence
  Synthetic construct
taactagccaagcagctagt

SEQ ID NO: 342 - DNA, 20 bp, Artificial Sequence
  Synthetic construct
aactagccaagcagctagtt

SEQ ID NO: 343 - DNA, 20 bp, Artificial Sequence
  Synthetic construct
actagccaagcagctagtta

SEQ ID NO: 344 - DNA, 20 bp, Artificial Sequence
  Synthetic construct
ctagccaagcagctagttac

SEQ ID NO: 345 - DNA, 20 bp, Artificial Sequence
  Synthetic construct
tagccaagcagctagttacc

SEQ ID NO: 346 - DNA, 20 bp, Artificial Sequence
  Synthetic construct
agccaagcagctagttacca

SEQ ID NO: 347 - DNA, 20 bp, Artificial Sequence
  Synthetic construct
gccaagcagctagttaccaa

SEQ ID NO: 348 - DNA, 20 bp, Artificial Sequence
  Synthetic construct
ccaagcagctagttaccaaa

SEQ ID NO: 349 - DNA, 20 bp, Artificial Sequence
  Synthetic construct
caagcagctagttaccaaat

SEQ ID NO: 350 - DNA, 20 bp, Artificial Sequence
  Synthetic construct
aagcagctagttaccaaatc

SEQ ID NO: 351 - DNA, 20 bp, Artificial Sequence
  Synthetic construct
agcagctagttaccaaatcg

SEQ ID NO: 352 - DNA, 20 bp, Artificial Sequence
  Synthetic construct
gcagctagttaccaaatcgg

SEQ ID NO: 353 - DNA, 20 bp, Artificial Sequence
  Synthetic construct
cagctagttaccaaatcggg

SEQ ID NO: 354 - DNA, 20 bp, Artificial Sequence
  Synthetic construct
agctagttaccaaatcggga

SEQ ID NO: 355 - DNA, 20 bp, Artificial Sequence
  Synthetic construct
gctagttaccaaatcgggag

SEQ ID NO: 356 - DNA, 20 bp, Artificial Sequence
  Synthetic construct
ctagttaccaaatcgggaga

SEQ ID NO: 357 - DNA, 20 bp, Artificial Sequence
  Synthetic construct
tagttaccaaatcgggagaa

SEQ ID NO: 358 - DNA, 20 bp, Artificial Sequence
  Synthetic construct
agttaccaaatcgggagaat

SEQ ID NO: 359 - DNA, 20 bp, Artificial Sequence
  Synthetic construct
gttaccaaatcgggagaatc

SEQ ID NO: 360 - DNA, 20 bp, Artificial Sequence
  Synthetic construct
ttaccaaatcgggagaatcc

SEQ ID NO: 361 - DNA, 20 bp, Artificial Sequence
  Synthetic construct
taccaaatcgggagaatccc

SEQ ID NO: 362 - DNA, 20 bp, Artificial Sequence
  Synthetic construct
accaaatcgggagaatcccg

SEQ ID NO: 363 - DNA, 20 bp, Artificial Sequence
  Synthetic construct
ccaaatcgggagaatcccgg

SEQ ID NO: 364 - DNA, 20 bp, Artificial Sequence
  Synthetic construct
caaatcgggagaatcccggg

SEQ ID NO: 365 - DNA, 20 bp, Artificial Sequence
  Synthetic construct
aaatcgggagaatcccgggt

SEQ ID NO: 366 - DNA, 20 bp, Artificial Sequence
  Synthetic construct
aatcgggagaatcccgggtc

SEQ ID NO: 367 - DNA, 20 bp, Artificial Sequence
  Synthetic construct
atcgggagaatcccgggtcc

SEQ ID NO: 368 - DNA, 20 bp, Artificial Sequence
  Synthetic construct
tcgggagaatcccgggtcct

SEQ ID NO: 369 - DNA, 20 bp, Artificial Sequence
  Synthetic construct
cgggagaatcccgggtcctc

SEQ ID NO: 370 - DNA, 20 bp, Artificial Sequence
  Synthetic construct
gggagaatcccgggtcctct

SEQ ID NO: 371 - DNA, 20 bp, Artificial Sequence
  Synthetic construct
ggagaatcccgggtcctctc

SEQ ID NO: 372 - DNA, 20 bp, Artificial Sequence
  Synthetic construct
gagaatcccgggtcctctct

SEQ ID NO: 373 - DNA, 20 bp, Artificial Sequence
  Synthetic construct
agaatcccgggtcctctctt

SEQ ID NO: 374 - DNA, 20 bp, Artificial Sequence
  Synthetic construct
gaatcccgggtcctctcttt

SEQ ID NO: 375 - DNA, 20 bp, Artificial Sequence
  Synthetic construct
aatcccgggtcctctcttta

SEQ ID NO: 376 - DNA, 20 bp, Artificial Sequence
  Synthetic construct
atcccgggtcctctctttag

SEQ ID NO: 377 - DNA, 20 bp, Artificial Sequence
  Synthetic construct
tcccgggtcctctctttagg

SEQ ID NO: 378 - DNA, 20 bp, Artificial Sequence
  Synthetic construct
cccgggtcctctctttaggg

SEQ ID NO: 379 - DNA, 20 bp, Artificial Sequence
  Synthetic construct
ccgggtcctctctttagggg

SEQ ID NO: 380 - DNA, 20 bp, Artificial Sequence
  Synthetic construct
cgggtcctctctttaggggg

SEQ ID NO: 381 - DNA, 20 bp, Artificial Sequence
  Synthetic construct
gggtcctctctttaggggga

SEQ ID NO: 382 - DNA, 20 bp, Artificial Sequence
  Synthetic construct
ggtcctctctttagggggag

SEQ ID NO: 383 - DNA, 20 bp, Artificial Sequence
  Synthetic construct
gtcctctctttagggggagg

SEQ ID NO: 384 - DNA, 20 bp, Artificial Sequence
  Synthetic construct
tcctctctttagggggaggt

SEQ ID NO: 385 - DNA, 20 bp, Artificial Sequence
  Synthetic construct
cctctctttagggggaggtc

SEQ ID NO: 386 - DNA, 20 bp, Artificial Sequence
  Synthetic construct
ctctctttagggggaggtcc

SEQ ID NO: 387 - DNA, 20 bp, Artificial Sequence
  Synthetic construct
tctctttagggggaggtccc

SEQ ID NO: 388 - DNA, 20 bp, Artificial Sequence
  Synthetic construct
ctctttagggggaggtccct

SEQ ID NO: 389 - DNA, 20 bp, Artificial Sequence
  Synthetic construct
tctttagggggaggtccctg

SEQ ID NO: 390 - DNA, 20 bp, Artificial Sequence
  Synthetic construct
ctttagggggaggtccctgg

SEQ ID NO: 391 - DNA, 20 bp, Artificial Sequence
  Synthetic construct
tttagggggaggtccctggg

SEQ ID NO: 392 - DNA, 20 bp, Artificial Sequence
  Synthetic construct
ttagggggaggtccctgggc

SEQ ID NO: 393 - DNA, 20 bp, Artificial Sequence
  Synthetic construct
tagggggaggtccctgggcc

SEQ ID NO: 394 - DNA, 20 bp, Artificial Sequence
  Synthetic construct
agggggaggtccctgggccg

SEQ ID NO: 395 - DNA, 20 bp, Artificial Sequence
  Synthetic construct
gggggaggtccctgggccga

SEQ ID NO: 396 - DNA, 20 bp, Artificial Sequence
  Synthetic construct
ggggaggtccctgggccgaa

SEQ ID NO: 397 - DNA, 20 bp, Artificial Sequence
  Synthetic construct
gggaggtccctgggccgaag

SEQ ID NO: 398 - DNA, 20 bp, Artificial Sequence
  Synthetic construct
ggaggtccctgggccgaagc

SEQ ID NO: 399 - DNA, 20 bp, Artificial Sequence
  Synthetic construct
gaggtccctgggccgaagcc

SEQ ID NO: 400 - DNA, 20 bp, Artificial Sequence
  Synthetic construct
aggtccctgggccgaagccc

SEQ ID NO: 401 - DNA, 20 bp, Artificial Sequence
  Synthetic construct
ggtccctgggccgaagcccg

SEQ ID NO: 402 - DNA, 20 bp, Artificial Sequence
  Synthetic construct
gtccctgggccgaagcccgc

SEQ ID NO: 403 - DNA, 20 bp, Artificial Sequence
  Synthetic construct
tccctgggccgaagcccgcc

SEQ ID NO: 404 - DNA, 20 bp, Artificial Sequence
  Synthetic construct
ccctgggccgaagcccgccc

SEQ ID NO: 405 - DNA, 20 bp, Artificial Sequence
  Synthetic construct
cctgggccgaagcccgccca

SEQ ID NO: 406 - DNA, 20 bp, Artificial Sequence
  Synthetic construct
ctgggccgaagcccgcccac

SEQ ID NO: 407 - DNA, 20 bp, Artificial Sequence
  Synthetic construct
tgggccgaagcccgcccacc

SEQ ID NO: 408 - DNA, 20 bp, Artificial Sequence
  Synthetic construct
gggccgaagcccgcccacct

SEQ ID NO: 409 - DNA, 20 bp, Artificial Sequence
  Synthetic construct
ggccgaagcccgcccacctt

SEQ ID NO: 410 - DNA, 20 bp, Artificial Sequence
  Synthetic construct
gccgaagcccgcccaccttt

SEQ ID NO: 411 - DNA, 20 bp, Artificial Sequence
  Synthetic construct
ccgaagcccgcccacctttc

SEQ ID NO: 412 - DNA, 20 bp, Artificial Sequence
  Synthetic construct
cgaagcccgcccacctttcg

SEQ ID NO: 413 - DNA, 20 bp, Artificial Sequence
  Synthetic construct
gaagcccgcccacctttcgg

SEQ ID NO: 414 - DNA, 20 bp, Artificial Sequence
  Synthetic construct
aagcccgcccacctttcggt

SEQ ID NO: 415 - DNA, 20 bp, Artificial Sequence
  Synthetic construct
agcccgcccacctttcggtg

SEQ ID NO: 416 - DNA, 20 bp, Artificial Sequence
  Synthetic construct
gcccgcccacctttcggtgg

SEQ ID NO: 417 - DNA, 20 bp, Artificial Sequence
  Synthetic construct
cccgcccacctttcggtgga

SEQ ID NO: 418 - DNA, 20 bp, Artificial Sequence
  Synthetic construct
ccgcccacctttcggtggag

SEQ ID NO: 419 - DNA, 20 bp, Artificial Sequence
  Synthetic construct
cgcccacctttcggtggagc

SEQ ID NO: 420 - DNA, 20 bp, Artificial Sequence
  Synthetic construct
gcccacctttcggtggagcc

SEQ ID NO: 421 - DNA, 20 bp, Artificial Sequence
  Synthetic construct
cccacctttcggtggagccg

SEQ ID NO: 422 - DNA, 20 bp, Artificial Sequence
  Synthetic construct
ccacctttcggtggagccgg

SEQ ID NO: 423 - DNA, 20 bp, Artificial Sequence
  Synthetic construct
cacctttcggtggagccgga

SEQ ID NO: 424 - DNA, 20 bp, Artificial Sequence
  Synthetic construct
acctttcggtggagccggac

SEQ ID NO: 425 - DNA, 20 bp, Artificial Sequence
  Synthetic construct
cctttcggtggagccggacc

SEQ ID NO: 426 - DNA, 20 bp, Artificial Sequence
  Synthetic construct
ctttcggtggagccggaccg

SEQ ID NO: 427 - DNA, 20 bp, Artificial Sequence
  Synthetic construct
tttcggtggagccggaccgc

SEQ ID NO: 428 - DNA, 20 bp, Artificial Sequence
  Synthetic construct
ttcggtggagccggaccgct

SEQ ID NO: 429 - DNA, 20 bp, Artificial Sequence
  Synthetic construct
tcggtggagccggaccgctt

SEQ ID NO: 430 - DNA, 20 bp, Artificial Sequence
  Synthetic construct
cggtggagccggaccgcttt

SEQ ID NO: 431 - DNA, 20 bp, Artificial Sequence
  Synthetic construct
ggtggagccggaccgctttc

SEQ ID NO: 432 - DNA, 20 bp, Artificial Sequence
  Synthetic construct
gtggagccggaccgctttcg

SEQ ID NO: 433 - DNA, 20 bp, Artificial Sequence
  Synthetic construct
tggagccggaccgctttcgc

SEQ ID NO: 434 - DNA, 20 bp, Artificial Sequence
  Synthetic construct
ggagccggaccgctttcgca

SEQ ID NO: 435 - DNA, 20 bp, Artificial Sequence
  Synthetic construct
gagccggaccgctttcgcac

SEQ ID NO: 436 - DNA, 20 bp, Artificial Sequence
  Synthetic construct
agccggaccgctttcgcacc

SEQ ID NO: 437 - DNA, 20 bp, Artificial Sequence
  Synthetic construct
gccggaccgctttcgcaccc

SEQ ID NO: 438 - DNA, 20 bp, Artificial Sequence
  Synthetic construct
ccggaccgctttcgcacccg

SEQ ID NO: 439 - DNA, 20 bp, Artificial Sequence
  Synthetic construct
cggaccgctttcgcacccgt

SEQ ID NO: 440 - DNA, 20 bp, Artificial Sequence
  Synthetic construct
ggaccgctttcgcacccgtg

SEQ ID NO: 441 - DNA, 20 bp, Artificial Sequence
  Synthetic construct
gaccgctttcgcacccgtgc

SEQ ID NO: 442 - DNA, 20 bp, Artificial Sequence
  Synthetic construct
accgctttcgcacccgtgct

SEQ ID NO: 443 - DNA, 20 bp, Artificial Sequence
  Synthetic construct
ccgctttcgcacccgtgctc

SEQ ID NO: 444 - DNA, 20 bp, Artificial Sequence
  Synthetic construct
cgctttcgcacccgtgctct

SEQ ID NO: 445 - DNA, 20 bp, Artificial Sequence
  Synthetic construct
gctttcgcacccgtgctctt

SEQ ID NO: 446 - DNA, 20 bp, Artificial Sequence
  Synthetic construct
ctttcgcacccgtgctcttt

SEQ ID NO: 447 - DNA, 20 bp, Artificial Sequence
  Synthetic construct
tttcgcacccgtgctctttc

SEQ ID NO: 448 - DNA, 20 bp, Artificial Sequence
  Synthetic construct
ttcgcacccgtgctctttcg

SEQ ID NO: 449 - DNA, 20 bp, Artificial Sequence
  Synthetic construct
tcgcacccgtgctctttcga

SEQ ID NO: 450 - DNA, 20 bp, Artificial Sequence
  Synthetic construct
cgcacccgtgctctttcgag

SEQ ID NO: 451 - DNA, 20 bp, Artificial Sequence
  Synthetic construct
gcacccgtgctctttcgagc

SEQ ID NO: 452 - DNA, 20 bp, Artificial Sequence
  Synthetic construct
cacccgtgctctttcgagca

SEQ ID NO: 453 - DNA, 20 bp, Artificial Sequence
  Synthetic construct
acccgtgctctttcgagcac

SEQ ID NO: 454 - DNA, 20 bp, Artificial Sequence
  Synthetic construct
cccgtgctctttcgagcaca

SEQ ID NO: 455 - DNA, 20 bp, Artificial Sequence
  Synthetic construct
ccgtgctctttcgagcacac

SEQ ID NO: 456 - DNA, 20 bp, Artificial Sequence
  Synthetic construct
cgtgctctttcgagcacacc

SEQ ID NO: 457 - DNA, 20 bp, Artificial Sequence
  Synthetic construct
gtgctctttcgagcacaccc

SEQ ID NO: 458 - DNA, 20 bp, Artificial Sequence
  Synthetic construct
tgctctttcgagcacaccca

SEQ ID NO: 459 - DNA, 20 bp, Artificial Sequence
  Synthetic construct
gctctttcgagcacacccac

SEQ ID NO: 460 - DNA, 20 bp, Artificial Sequence
  Synthetic construct
ctctttcgagcacacccacc

SEQ ID NO: 461 - DNA, 20 bp, Artificial Sequence
  Synthetic construct
tctttcgagcacacccaccc

SEQ ID NO: 462 - DNA, 20 bp, Artificial Sequence
  Synthetic construct
ctttcgagcacacccacccc

SEQ ID NO: 463 - DNA, 20 bp, Artificial Sequence
  Synthetic construct
tttcgagcacacccaccccg

SEQ ID NO: 464 - DNA, 20 bp, Artificial Sequence
  Synthetic construct
ttcgagcacacccaccccgt

SEQ ID NO: 465 - DNA, 20 bp, Artificial Sequence
  Synthetic construct
tcgagcacacccaccccgtt

SEQ ID NO: 466 - DNA, 20 bp, Artificial Sequence
  Synthetic construct
cgagcacacccaccccgttt

SEQ ID NO: 467 - DNA, 20 bp, Artificial Sequence
  Synthetic construct
gagcacacccaccccgttta

SEQ ID NO: 468 - DNA, 20 bp, Artificial Sequence
  Synthetic construct
agcacacccaccccgtttac

SEQ ID NO: 469 - DNA, 20 bp, Artificial Sequence
  Synthetic construct
gcacacccaccccgtttacg

SEQ ID NO: 470 - DNA, 20 bp, Artificial Sequence
  Synthetic construct
cacacccaccccgtttacgg

SEQ ID NO: 471 - DNA, 20 bp, Artificial Sequence
  Synthetic construct
acacccaccccgtttacggg

SEQ ID NO: 472 - DNA, 20 bp, Artificial Sequence
  Synthetic construct
cacccaccccgtttacgggg

SEQ ID NO: 473 - DNA, 20 bp, Artificial Sequence
  Synthetic construct
acccaccccgtttacggggg

SEQ ID NO: 474 - DNA, 20 bp, Artificial Sequence
  Synthetic construct
cccaccccgtttacgggggt

SEQ ID NO: 475 - DNA, 20 bp, Artificial Sequence
  Synthetic construct
ccaccccgtttacgggggtc

SEQ ID NO: 476 - DNA, 20 bp, Artificial Sequence
  Synthetic construct
caccccgtttacgggggtcc

SEQ ID NO: 477 - DNA, 20 bp, Artificial Sequence
  Synthetic construct
accccgtttacgggggtccc

SEQ ID NO: 478 - DNA, 20 bp, Artificial Sequence
  Synthetic construct
ccccgtttacgggggtccct

SEQ ID NO: 479 - DNA, 20 bp, Artificial Sequence
  Synthetic construct
cccgtttacgggggtccctc

SEQ ID NO: 480 - DNA, 20 bp, Artificial Sequence
  Synthetic construct
ccgtttacgggggtccctcg

SEQ ID NO: 481 - DNA, 20 bp, Artificial Sequence
  Synthetic construct
cgtttacgggggtccctcgg

SEQ ID NO: 482 - DNA, 20 bp, Artificial Sequence
  Synthetic construct
gtttacgggggtccctcggt

SEQ ID NO: 483 - DNA, 20 bp, Artificial Sequence
  Synthetic construct
tttacgggggtccctcggtc

SEQ ID NO: 484 - DNA, 20 bp, Artificial Sequence
  Synthetic construct
ttacgggggtccctcggtca

SEQ ID NO: 485 - DNA, 20 bp, Artificial Sequence
  Synthetic construct
tacgggggtccctcggtcag

SEQ ID NO: 486 - DNA, 20 bp, Artificial Sequence
  Synthetic construct
acgggggtccctcggtcagc

SEQ ID NO: 487 - DNA, 20 bp, Artificial Sequence
  Synthetic construct
cgggggtccctcggtcagct

SEQ ID NO: 488 - DNA, 20 bp, Artificial Sequence
  Synthetic construct
gggggtccctcggtcagcta

SEQ ID NO: 489 - DNA, 20 bp, Artificial Sequence
  Synthetic construct
ggggtccctcggtcagctac

SEQ ID NO: 490 - DNA, 20 bp, Artificial Sequence
  Synthetic construct
gggtccctcggtcagctacc

SEQ ID NO: 491 - DNA, 20 bp, Artificial Sequence
  Synthetic construct
ggtccctcggtcagctaccg

SEQ ID NO: 492 - DNA, 20 bp, Artificial Sequence
  Synthetic construct
gtccctcggtcagctaccga

SEQ ID NO: 493 - DNA, 20 bp, Artificial Sequence
  Synthetic construct
tccctcggtcagctaccgag

SEQ ID NO: 494 - DNA, 20 bp, Artificial Sequence
  Synthetic construct
ccctcggtcagctaccgagg

SEQ ID NO: 495 - DNA, 20 bp, Artificial Sequence
  Synthetic construct
cctcggtcagctaccgagga

SEQ ID NO: 496 - DNA, 20 bp, Artificial Sequence
  Synthetic construct
ctcggtcagctaccgaggag

SEQ ID NO: 497 - DNA, 20 bp, Artificial Sequence
  Synthetic construct
tcggtcagctaccgaggaga

SEQ ID NO: 498 - DNA, 20 bp, Artificial Sequence
  Synthetic construct
cggtcagctaccgaggagag

SEQ ID NO: 499 - DNA, 20 bp, Artificial Sequence
  Synthetic construct
ggtcagctaccgaggagagc

SEQ ID NO: 500 - DNA, 20 bp, Artificial Sequence
  Synthetic construct
gtcagctaccgaggagagct

SEQ ID NO: 501 - DNA, 20 bp, Artificial Sequence
  Synthetic construct
tcagctaccgaggagagctc

SEQ ID NO: 502 - DNA, 20 bp, Artificial Sequence
  Synthetic construct
cagctaccgaggagagctcg

SEQ ID NO: 503 - DNA, 20 bp, Artificial Sequence
  Synthetic construct
agctaccgaggagagctcgc

SEQ ID NO: 504 - DNA, 20 bp, Artificial Sequence
  Synthetic construct
gctaccgaggagagctcgct

SEQ ID NO: 505 - DNA, 20 bp, Artificial Sequence
  Synthetic construct
ctaccgaggagagctcgctg

SEQ ID NO: 506 - DNA, 20 bp, Artificial Sequence
  Synthetic construct
taccgaggagagctcgctgg

SEQ ID NO: 507 - DNA, 20 bp, Artificial Sequence
  Synthetic construct
accgaggagagctcgctggc

SEQ ID NO: 508 - DNA, 20 bp, Artificial Sequence
  Synthetic construct
ccgaggagagctcgctggcc

SEQ ID NO: 509 - DNA, 20 bp, Artificial Sequence
  Synthetic construct
cgaggagagctcgctggccc

SEQ ID NO: 510 - DNA, 20 bp, Artificial Sequence
  Synthetic construct
gaggagagctcgctggccca

SEQ ID NO: 511 - DNA, 20 bp, Artificial Sequence
  Synthetic construct
aggagagctcgctggcccac

SEQ ID NO: 512 - DNA, 20 bp, Artificial Sequence
  Synthetic construct
ggagagctcgctggcccaca

SEQ ID NO: 513 - DNA, 20 bp, Artificial Sequence
  Synthetic construct
gagagctcgctggcccacac

SEQ ID NO: 514 - DNA, 20 bp, Artificial Sequence
  Synthetic construct
agagctcgctggcccacact

SEQ ID NO: 515 - DNA, 20 bp, Artificial Sequence
  Synthetic construct
gagctcgctggcccacactc

SEQ ID NO: 516 - DNA, 20 bp, Artificial Sequence
  Synthetic construct
agctcgctggcccacactcc

SEQ ID NO: 517 - DNA, 20 bp, Artificial Sequence
  Synthetic construct
gctcgctggcccacactcct

SEQ ID NO: 518 - DNA, 20 bp, Artificial Sequence
  Synthetic construct
ctcgctggcccacactcctg

SEQ ID NO: 519 - DNA, 20 bp, Artificial Sequence
  Synthetic construct
tcgctggcccacactcctga

SEQ ID NO: 520 - DNA, 20 bp, Artificial Sequence
  Synthetic construct
cgctggcccacactcctgag

SEQ ID NO: 521 - DNA, 20 bp, Artificial Sequence
  Synthetic construct
gctggcccacactcctgagg

SEQ ID NO: 522 - DNA, 20 bp, Artificial Sequence
  Synthetic construct
ctggcccacactcctgaggg

SEQ ID NO: 523 - DNA, 20 bp, Artificial Sequence
  Synthetic construct
tggcccacactcctgaggga

SEQ ID NO: 524 - DNA, 20 bp, Artificial Sequence
  Synthetic construct
ggcccacactcctgagggaa

SEQ ID NO: 525 - DNA, 20 bp, Artificial Sequence
  Synthetic construct
gcccacactcctgagggaat

SEQ ID NO: 526 - DNA, 20 bp, Artificial Sequence
  Synthetic construct
cccacactcctgagggaatg

SEQ ID NO: 527 - DNA, 20 bp, Artificial Sequence
  Synthetic construct
ccacactcctgagggaatgt

SEQ ID NO: 528 - DNA, 20 bp, Artificial Sequence
  Synthetic construct
cacactcctgagggaatgtg

SEQ ID NO: 529 - DNA, 20 bp, Artificial Sequence
  Synthetic construct
acactcctgagggaatgtgg

SEQ ID NO: 530 - DNA, 20 bp, Artificial Sequence
  Synthetic construct
cactcctgagggaatgtggg

SEQ ID NO: 531 - DNA, 20 bp, Artificial Sequence
  Synthetic construct
actcctgagggaatgtggga

SEQ ID NO: 532 - DNA, 20 bp, Artificial Sequence
  Synthetic construct
ctcctgagggaatgtgggaa

SEQ ID NO: 533 - DNA, 20 bp, Artificial Sequence
  Synthetic construct
tcctgagggaatgtgggaac

SEQ ID NO: 534 - DNA, 20 bp, Artificial Sequence
  Synthetic construct
cctgagggaatgtgggaacc

SEQ ID NO: 535 - DNA, 20 bp, Artificial Sequence
  Synthetic construct
ctgagggaatgtgggaaccg

SEQ ID NO: 536 - DNA, 20 bp, Artificial Sequence
  Synthetic construct
tgagggaatgtgggaaccgg

SEQ ID NO: 537 - DNA, 20 bp, Artificial Sequence
  Synthetic construct
gagggaatgtgggaaccggc

SEQ ID NO: 538 - DNA, 20 bp, Artificial Sequence
  Synthetic construct
agggaatgtgggaaccggcg

SEQ ID NO: 539 - DNA, 20 bp, Artificial Sequence
  Synthetic construct
gggaatgtgggaaccggcgt

SEQ ID NO: 540 - DNA, 20 bp, Artificial Sequence
  Synthetic construct
ggaatgtgggaaccggcgtt

SEQ ID NO: 541 - DNA, 20 bp, Artificial Sequence
  Synthetic construct
gaatgtgggaaccggcgtta

SEQ ID NO: 542 - DNA, 20 bp, Artificial Sequence
  Synthetic construct
aatgtgggaaccggcgttag

SEQ ID NO: 543 - DNA, 20 bp, Artificial Sequence
  Synthetic construct
atgtgggaaccggcgttagc

SEQ ID NO: 544 - DNA, 20 bp, Artificial Sequence
  Synthetic construct
tgtgggaaccggcgttagcc

SEQ ID NO: 545 - DNA, 20 bp, Artificial Sequence
  Synthetic construct
gtgggaaccggcgttagcca

SEQ ID NO: 546 - DNA, 20 bp, Artificial Sequence
  Synthetic construct
tgggaaccggcgttagccac

SEQ ID NO: 547 - DNA, 20 bp, Artificial Sequence
  Synthetic construct
gggaaccggcgttagccact

SEQ ID NO: 548 - DNA, 20 bp, Artificial Sequence
  Synthetic construct
ggaaccggcgttagccactc

SEQ ID NO: 549 - DNA, 20 bp, Artificial Sequence
  Synthetic construct
gaaccggcgttagccactcc

SEQ ID NO: 550 - DNA, 20 bp, Artificial Sequence
  Synthetic construct
aaccggcgttagccactccg

SEQ ID NO: 551 - DNA, 20 bp, Artificial Sequence
  Synthetic construct
accggcgttagccactccga

SEQ ID NO: 552 - DNA, 20 bp, Artificial Sequence
  Synthetic construct
ccggcgttagccactccgaa

SEQ ID NO: 553 - DNA, 20 bp, Artificial Sequence
  Synthetic construct
cggcgttagccactccgaag

SEQ ID NO: 554 - DNA, 20 bp, Artificial Sequence
  Synthetic construct
ggcgttagccactccgaagt

SEQ ID NO: 555 - DNA, 20 bp, Artificial Sequence
  Synthetic construct
gcgttagccactccgaagtg

SEQ ID NO: 556 - DNA, 20 bp, Artificial Sequence
  Synthetic construct
cgttagccactccgaagtgc

SEQ ID NO: 557 - DNA, 20 bp, Artificial Sequence
  Synthetic construct
gttagccactccgaagtgcg

SEQ ID NO: 558 - DNA, 20 bp, Artificial Sequence
  Synthetic construct
ttagccactccgaagtgcgt

SEQ ID NO: 559 - DNA, 20 bp, Artificial Sequence
  Synthetic construct
tagccactccgaagtgcgta

SEQ ID NO: 560 - DNA, 20 bp, Artificial Sequence
  Synthetic construct
agccactccgaagtgcgtat

SEQ ID NO: 561 - DNA, 20 bp, Artificial Sequence
  Synthetic construct
gccactccgaagtgcgtata

SEQ ID NO: 562 - DNA, 20 bp, Artificial Sequence
  Synthetic construct
ccactccgaagtgcgtataa

SEQ ID NO: 563 - DNA, 20 bp, Artificial Sequence
  Synthetic construct
cactccgaagtgcgtataac

SEQ ID NO: 564 - DNA, 20 bp, Artificial Sequence
  Synthetic construct
actccgaagtgcgtataacg

SEQ ID NO: 565 - DNA, 20 bp, Artificial Sequence
  Synthetic construct
ctccgaagtgcgtataacgc

SEQ ID NO: 566 - DNA, 20 bp, Artificial Sequence
  Synthetic construct
tccgaagtgcgtataacgcg

SEQ ID NO: 567 - DNA, 20 bp, Artificial Sequence
  Synthetic construct
ccgaagtgcgtataacgcgc

SEQ ID NO: 568 - DNA, 20 bp, Artificial Sequence
  Synthetic construct
cgaagtgcgtataacgcgca

SEQ ID NO: 569 - DNA, 20 bp, Artificial Sequence
  Synthetic construct
gaagtgcgtataacgcgcac

SEQ ID NO: 570 - DNA, 20 bp, Artificial Sequence
  Synthetic construct
aagtgcgtataacgcgcacg

SEQ ID NO: 571 - DNA, 20 bp, Artificial Sequence
  Synthetic construct
agtgcgtataacgcgcacgc

SEQ ID NO: 572 - DNA, 20 bp, Artificial Sequence
  Synthetic construct
gtgcgtataacgcgcacgcc

SEQ ID NO: 573 - DNA, 20 bp, Artificial Sequence
  Synthetic construct
tgcgtataacgcgcacgccg

SEQ ID NO: 574 - DNA, 20 bp, Artificial Sequence
  Synthetic construct
gcgtataacgcgcacgccgg

SEQ ID NO: 575 - DNA, 20 bp, Artificial Sequence
  Synthetic construct
cgtataacgcgcacgccggc

SEQ ID NO: 576 - DNA, 20 bp, Artificial Sequence
  Synthetic construct
gtataacgcgcacgccggcg

SEQ ID NO: 577 - DNA, 20 bp, Artificial Sequence
  Synthetic construct
tataacgcgcacgccggcgg

SEQ ID NO: 578 - DNA, 20 bp, Artificial Sequence
  Synthetic construct
ataacgcgcacgccggcgga

SEQ ID NO: 579 - DNA, 20 bp, Artificial Sequence
  Synthetic construct
taacgcgcacgccggcggac

SEQ ID NO: 580 - DNA, 20 bp, Artificial Sequence
  Synthetic construct
aacgcgcacgccggcggact

SEQ ID NO: 581 - DNA, 20 bp, Artificial Sequence
  Synthetic construct
acgcgcacgccggcggactt

SEQ ID NO: 582 - DNA, 20 bp, Artificial Sequence
  Synthetic construct
cgcgcacgccggcggacttc

SEQ ID NO: 583 - DNA, 20 bp, Artificial Sequence
  Synthetic construct
gcgcacgccggcggacttca

SEQ ID NO: 584 - DNA, 20 bp, Artificial Sequence
  Synthetic construct
cgcacgccggcggacttcat

SEQ ID NO: 585 - DNA, 20 bp, Artificial Sequence
  Synthetic construct
gcacgccggcggacttcatg

SEQ ID NO: 586 - DNA, 20 bp, Artificial Sequence
  Synthetic construct
cacgccggcggacttcatgc

SEQ ID NO: 587 - DNA, 20 bp, Artificial Sequence
  Synthetic construct
acgccggcggacttcatgct

SEQ ID NO: 588 - DNA, 20 bp, Artificial Sequence
  Synthetic construct
cgccggcggacttcatgctg

SEQ ID NO: 589 - DNA, 20 bp, Artificial Sequence
  Synthetic construct
gccggcggacttcatgctgt

SEQ ID NO: 590 - DNA, 20 bp, Artificial Sequence
  Synthetic construct
ccggcggacttcatgctgtc

SEQ ID NO: 591 - DNA, 20 bp, Artificial Sequence
  Synthetic construct
cggcggacttcatgctgtcg

SEQ ID NO: 592 - DNA, 20 bp, Artificial Sequence
  Synthetic construct
ggcggacttcatgctgtcgg

SEQ ID NO: 593 - DNA, 20 bp, Artificial Sequence
  Synthetic construct
gcggacttcatgctgtcggt

SEQ ID NO: 594 - DNA, 20 bp, Artificial Sequence
  Synthetic construct
cggacttcatgctgtcggtg

SEQ ID NO: 595 - DNA, 20 bp, Artificial Sequence
  Synthetic construct
ggacttcatgctgtcggtga

SEQ ID NO: 596 - DNA, 20 bp, Artificial Sequence
  Synthetic construct
gacttcatgctgtcggtgat

SEQ ID NO: 597 - DNA, 20 bp, Artificial Sequence
  Synthetic construct
acttcatgctgtcggtgatt

SEQ ID NO: 598 - DNA, 20 bp, Artificial Sequence
  Synthetic construct
cttcatgctgtcggtgattt

SEQ ID NO: 599 - DNA, 20 bp, Artificial Sequence
  Synthetic construct
ttcatgctgtcggtgatttc

SEQ ID NO: 600 - DNA, 20 bp, Artificial Sequence
  Synthetic construct
tcatgctgtcggtgatttca

SEQ ID NO: 601 - DNA, 20 bp, Artificial Sequence
  Synthetic construct
catgctgtcggtgatttcac

SEQ ID NO: 602 - DNA, 20 bp, Artificial Sequence
  Synthetic construct
atgctgtcggtgatttcacc

SEQ ID NO: 603 - DNA, 20 bp, Artificial Sequence
  Synthetic construct
tgctgtcggtgatttcacct

SEQ ID NO: 604 - DNA, 20 bp, Artificial Sequence
  Synthetic construct
gctgtcggtgatttcacctc

SEQ ID NO: 605 - DNA, 20 bp, Artificial Sequence
  Synthetic construct
ctgtcggtgatttcacctcc

SEQ ID NO: 606 - DNA, 20 bp, Artificial Sequence
  Synthetic construct
tgtcggtgatttcacctcca

SEQ ID NO: 607 - DNA, 20 bp, Artificial Sequence
  Synthetic construct
gtcggtgatttcacctccag

SEQ ID NO: 608 - DNA, 20 bp, Artificial Sequence
  Synthetic construct
tcggtgatttcacctccagt

SEQ ID NO: 609 - DNA, 20 bp, Artificial Sequence
  Synthetic construct
cggtgatttcacctccagta

SEQ ID NO: 610 - DNA, 20 bp, Artificial Sequence
  Synthetic construct
ggtgatttcacctccagtat

SEQ ID NO: 611 - DNA, 20 bp, Artificial Sequence
  Synthetic construct
gtgatttcacctccagtatg

SEQ ID NO: 612 - DNA, 20 bp, Artificial Sequence
  Synthetic construct
tgatttcacctccagtatgg

SEQ ID NO: 613 - DNA, 20 bp, Artificial Sequence
  Synthetic construct
gatttcacctccagtatgga

SEQ ID NO: 614 - DNA, 20 bp, Artificial Sequence
  Synthetic construct
atttcacctccagtatggaa

SEQ ID NO: 615 - DNA, 20 bp, Artificial Sequence
  Synthetic construct
tttcacctccagtatggaac

SEQ ID NO: 616 - DNA, 20 bp, Artificial Sequence
  Synthetic construct
ttcacctccagtatggaacc

SEQ ID NO: 617 - DNA, 20 bp, Artificial Sequence
  Synthetic construct
tcacctccagtatggaacca

SEQ ID NO: 618 - DNA, 20 bp, Artificial Sequence
  Synthetic construct
cacctccagtatggaaccac

SEQ ID NO: 619 - DNA, 20 bp, Artificial Sequence
  Synthetic construct
acctccagtatggaaccacg

SEQ ID NO: 620 - DNA, 20 bp, Artificial Sequence
  Synthetic construct
cctccagtatggaaccacgc

SEQ ID NO: 621 - DNA, 20 bp, Artificial Sequence
  Synthetic construct
ctccagtatggaaccacgct

SEQ ID NO: 622 - DNA, 20 bp, Artificial Sequence
  Synthetic construct
tccagtatggaaccacgcta

SEQ ID NO: 623 - DNA, 20 bp, Artificial Sequence
  Synthetic construct
ccagtatggaaccacgctat

SEQ ID NO: 624 - DNA, 20 bp, Artificial Sequence
  Synthetic construct
cagtatggaaccacgctatg

SEQ ID NO: 625 - DNA, 20 bp, Artificial Sequence
  Synthetic construct
agtatggaaccacgctatgt

SEQ ID NO: 626 - DNA, 20 bp, Artificial Sequence
  Synthetic construct
gtatggaaccacgctatgta

SEQ ID NO: 627 - DNA, 20 bp, Artificial Sequence
  Synthetic construct
tatggaaccacgctatgtag

SEQ ID NO: 628 - DNA, 20 bp, Artificial Sequence
  Synthetic construct
atggaaccacgctatgtagc

SEQ ID NO: 629 - DNA, 20 bp, Artificial Sequence
  Synthetic construct
tggaaccacgctatgtagcg

SEQ ID NO: 630 - DNA, 20 bp, Artificial Sequence
  Synthetic construct
ggaaccacgctatgtagcga

SEQ ID NO: 631 - DNA, 20 bp, Artificial Sequence
  Synthetic construct
gaaccacgctatgtagcgac

SEQ ID NO: 632 - DNA, 20 bp, Artificial Sequence
  Synthetic construct
aaccacgctatgtagcgacc

SEQ ID NO: 633 - DNA, 20 bp, Artificial Sequence
  Synthetic construct
accacgctatgtagcgacca

SEQ ID NO: 634 - DNA, 20 bp, Artificial Sequence
  Synthetic construct
ccacgctatgtagcgaccac

SEQ ID NO: 635 - DNA, 20 bp, Artificial Sequence
  Synthetic construct
cacgctatgtagcgaccact

SEQ ID NO: 636 - DNA, 20 bp, Artificial Sequence
  Synthetic construct
acgctatgtagcgaccactg

SEQ ID NO: 637 - DNA, 20 bp, Artificial Sequence
  Synthetic construct
cgctatgtagcgaccactgt

SEQ ID NO: 638 - DNA, 20 bp, Artificial Sequence
  Synthetic construct
gctatgtagcgaccactgtc

SEQ ID NO: 639 - DNA, 20 bp, Artificial Sequence
  Synthetic construct
ctatgtagcgaccactgtcg

SEQ ID NO: 640 - DNA, 20 bp, Artificial Sequence
  Synthetic construct
tatgtagcgaccactgtcgt

SEQ ID NO: 641 - DNA, 20 bp, Artificial Sequence
  Synthetic construct
atgtagcgaccactgtcgtg

SEQ ID NO: 642 - DNA, 20 bp, Artificial Sequence
  Synthetic construct
tgtagcgaccactgtcgtgc

SEQ ID NO: 643 - DNA, 20 bp, Artificial Sequence
  Synthetic construct
gtagcgaccactgtcgtgct

SEQ ID NO: 644 - DNA, 20 bp, Artificial Sequence
  Synthetic construct
tagcgaccactgtcgtgctt

SEQ ID NO: 645 - DNA, 20 bp, Artificial Sequence
  Synthetic construct
agcgaccactgtcgtgcttt

SEQ ID NO: 646 - DNA, 20 bp, Artificial Sequence
  Synthetic construct
gcgaccactgtcgtgctttt

SEQ ID NO: 647 - DNA, 20 bp, Artificial Sequence
  Synthetic construct
cgaccactgtcgtgcttttc

SEQ ID NO: 648 - DNA, 20 bp, Artificial Sequence
  Synthetic construct
gaccactgtcgtgcttttcg

SEQ ID NO: 649 - DNA, 20 bp, Artificial Sequence
  Synthetic construct
accactgtcgtgcttttcgc

SEQ ID NO: 650 - DNA, 20 bp, Artificial Sequence
  Synthetic construct
ccactgtcgtgcttttcgct

SEQ ID NO: 651 - DNA, 20 bp, Artificial Sequence
  Synthetic construct
cactgtcgtgcttttcgctg

SEQ ID NO: 652 - DNA, 20 bp, Artificial Sequence
  Synthetic construct
actgtcgtgcttttcgctga

SEQ ID NO: 653 - DNA, 20 bp, Artificial Sequence
  Synthetic construct
ctgtcgtgcttttcgctgaa

SEQ ID NO: 654 - DNA, 20 bp, Artificial Sequence
  Synthetic construct
tgtcgtgcttttcgctgaag

SEQ ID NO: 655 - DNA, 20 bp, Artificial Sequence
  Synthetic construct
gtcgtgcttttcgctgaaga

SEQ ID NO: 656 - DNA, 20 bp, Artificial Sequence
  Synthetic construct
tcgtgcttttcgctgaagaa

SEQ ID NO: 657 - DNA, 20 bp, Artificial Sequence
  Synthetic construct
cgtgcttttcgctgaagaac

SEQ ID NO: 658 - DNA, 20 bp, Artificial Sequence
  Synthetic construct
gtgcttttcgctgaagaact

SEQ ID NO: 659 - DNA, 20 bp, Artificial Sequence
  Synthetic construct
tgcttttcgctgaagaactt

SEQ ID NO: 660 - DNA, 20 bp, Artificial Sequence
  Synthetic construct
gcttttcgctgaagaacttg

SEQ ID NO: 661 - DNA, 20 bp, Artificial Sequence
  Synthetic construct
cttttcgctgaagaacttgc

SEQ ID NO: 662 - DNA, 20 bp, Artificial Sequence
  Synthetic construct
ttttcgctgaagaacttgcg

SEQ ID NO: 663 - DNA, 20 bp, Artificial Sequence
  Synthetic construct
tttcgctgaagaacttgcgt

SEQ ID NO: 664 - DNA, 20 bp, Artificial Sequence
  Synthetic construct
ttcgctgaagaacttgcgtt

SEQ ID NO: 665 - DNA, 20 bp, Artificial Sequence
  Synthetic construct
tcgctgaagaacttgcgttc

SEQ ID NO: 666 - DNA, 20 bp, Artificial Sequence
  Synthetic construct
cgctgaagaacttgcgttct

SEQ ID NO: 667 - DNA, 20 bp, Artificial Sequence
  Synthetic construct
gctgaagaacttgcgttctc

SEQ ID NO: 668 - DNA, 20 bp, Artificial Sequence
  Synthetic construct
ctgaagaacttgcgttctcg

SEQ ID NO: 669 - DNA, 20 bp, Artificial Sequence
  Synthetic construct
tgaagaacttgcgttctcga

SEQ ID NO: 670 - DNA, 20 bp, Artificial Sequence
  Synthetic construct
gaagaacttgcgttctcgag

SEQ ID NO: 671 - DNA, 20 bp, Artificial Sequence
  Synthetic construct
aagaacttgcgttctcgagc

SEQ ID NO: 672 - DNA, 20 bp, Artificial Sequence
  Synthetic construct
agaacttgcgttctcgagcg

SEQ ID NO: 673 - DNA, 20 bp, Artificial Sequence
  Synthetic construct
gaacttgcgttctcgagcga

SEQ ID NO: 674 - DNA, 20 bp, Artificial Sequence
  Synthetic construct
aacttgcgttctcgagcgat

SEQ ID NO: 675 - DNA, 20 bp, Artificial Sequence
  Synthetic construct
acttgcgttctcgagcgata

SEQ ID NO: 676 - DNA, 20 bp, Artificial Sequence
  Synthetic construct
cttgcgttctcgagcgatac

SEQ ID NO: 677 - DNA, 20 bp, Artificial Sequence
  Synthetic construct
ttgcgttctcgagcgatacg

SEQ ID NO: 678 - DNA, 20 bp, Artificial Sequence
  Synthetic construct
tgcgttctcgagcgatacga

SEQ ID NO: 679 - DNA, 20 bp, Artificial Sequence
  Synthetic construct
gcgttctcgagcgatacgag

SEQ ID NO: 680 - DNA, 20 bp, Artificial Sequence
  Synthetic construct
cgttctcgagcgatacgagc

SEQ ID NO: 681 - DNA, 20 bp, Artificial Sequence
  Synthetic construct
gttctcgagcgatacgagca

SEQ ID NO: 682 - DNA, 20 bp, Artificial Sequence
  Synthetic construct
ttctcgagcgatacgagcaa

SEQ ID NO: 683 - DNA, 20 bp, Artificial Sequence
  Synthetic construct
tctcgagcgatacgagcaag

SEQ ID NO: 684 - DNA, 20 bp, Artificial Sequence
  Synthetic construct
ctcgagcgatacgagcaaga

SEQ ID NO: 685 - DNA, 20 bp, Artificial Sequence
  Synthetic construct
tcgagcgatacgagcaagac

SEQ ID NO: 686 - DNA, 20 bp, Artificial Sequence
  Synthetic construct
cgagcgatacgagcaagacg

SEQ ID NO: 687 - DNA, 20 bp, Artificial Sequence
  Synthetic construct
gagcgatacgagcaagacgg

SEQ ID NO: 688 - DNA, 20 bp, Artificial Sequence
  Synthetic construct
agcgatacgagcaagacgga

SEQ ID NO: 689 - DNA, 20 bp, Artificial Sequence
  Synthetic construct
gcgatacgagcaagacggaa

SEQ ID NO: 690 - DNA, 20 bp, Artificial Sequence
  Synthetic construct
cgatacgagcaagacggaaa

SEQ ID NO: 691 - DNA, 20 bp, Artificial Sequence
  Synthetic construct
gatacgagcaagacggaaac

SEQ ID NO: 692 - DNA, 20 bp, Artificial Sequence
  Synthetic construct
atacgagcaagacggaaacc

SEQ ID NO: 693 - DNA, 20 bp, Artificial Sequence
  Synthetic construct
tacgagcaagacggaaaccc

SEQ ID NO: 694 - DNA, 20 bp, Artificial Sequence
  Synthetic construct
acgagcaagacggaaacccg

SEQ ID NO: 695 - DNA, 20 bp, Artificial Sequence
  Synthetic construct
cgagcaagacggaaacccga

SEQ ID NO: 696 - DNA, 20 bp, Artificial Sequence
  Synthetic construct
gagcaagacggaaacccgag

SEQ ID NO: 697 - DNA, 20 bp, Artificial Sequence
  Synthetic construct
agcaagacggaaacccgagg

SEQ ID NO: 698 - DNA, 20 bp, Artificial Sequence
  Synthetic construct
gcaagacggaaacccgaggt

SEQ ID NO: 699 - DNA, 20 bp, Artificial Sequence
  Synthetic construct
caagacggaaacccgaggta

SEQ ID NO: 700 - DNA, 20 bp, Artificial Sequence
  Synthetic construct
aagacggaaacccgaggtac

SEQ ID NO: 701 - DNA, 20 bp, Artificial Sequence
  Synthetic construct
agacggaaacccgaggtacg

SEQ ID NO: 702 - DNA, 20 bp, Artificial Sequence
  Synthetic construct
gacggaaacccgaggtacgg

SEQ ID NO: 703 - DNA, 20 bp, Artificial Sequence
  Synthetic construct
acggaaacccgaggtacggg

SEQ ID NO: 704 - DNA, 20 bp, Artificial Sequence
  Synthetic construct
cggaaacccgaggtacgggt

SEQ ID NO: 705 - DNA, 20 bp, Artificial Sequence
  Synthetic construct
ggaaacccgaggtacgggta

SEQ ID NO: 706 - DNA, 20 bp, Artificial Sequence
  Synthetic construct
gaaacccgaggtacgggtat

SEQ ID NO: 707 - DNA, 20 bp, Artificial Sequence
  Synthetic construct
aaacccgaggtacgggtatc

SEQ ID NO: 708 - DNA, 20 bp, Artificial Sequence
  Synthetic construct
aacccgaggtacgggtatcc

SEQ ID NO: 709 - DNA, 20 bp, Artificial Sequence
  Synthetic construct
acccgaggtacgggtatccg

SEQ ID NO: 710 - DNA, 20 bp, Artificial Sequence
  Synthetic construct
cccgaggtacgggtatccgc

SEQ ID NO: 711 - DNA, 20 bp, Artificial Sequence
  Synthetic construct
ccgaggtacgggtatccgcg

SEQ ID NO: 712 - DNA, 20 bp, Artificial Sequence
  Synthetic construct
cgaggtacgggtatccgcga

SEQ ID NO: 713 - DNA, 20 bp, Artificial Sequence
  Synthetic construct
gaggtacgggtatccgcgag

SEQ ID NO: 714 - DNA, 20 bp, Artificial Sequence
  Synthetic construct
aggtacgggtatccgcgagc

SEQ ID NO: 715 - DNA, 20 bp, Artificial Sequence
  Synthetic construct
ggtacgggtatccgcgagca

SEQ ID NO: 716 - DNA, 20 bp, Artificial Sequence
  Synthetic construct
gtacgggtatccgcgagcag

SEQ ID NO: 717 - DNA, 20 bp, Artificial Sequence
  Synthetic construct
tacgggtatccgcgagcagc

SEQ ID NO: 718 - DNA, 20 bp, Artificial Sequence
  Synthetic construct
acgggtatccgcgagcagcc

SEQ ID NO: 719 - DNA, 20 bp, Artificial Sequence
  Synthetic construct
cgggtatccgcgagcagccg

SEQ ID NO: 720 - DNA, 20 bp, Artificial Sequence
  Synthetic construct
gggtatccgcgagcagccgc

SEQ ID NO: 721 - DNA, 20 bp, Artificial Sequence
  Synthetic construct
ggtatccgcgagcagccgcc

SEQ ID NO: 722 - DNA, 20 bp, Artificial Sequence
  Synthetic construct
gtatccgcgagcagccgccc

SEQ ID NO: 723 - DNA, 20 bp, Artificial Sequence
  Synthetic construct
tatccgcgagcagccgcccg

SEQ ID NO: 724 - DNA, 20 bp, Artificial Sequence
  Synthetic construct
atccgcgagcagccgcccgt

SEQ ID NO: 725 - DNA, 20 bp, Artificial Sequence
  Synthetic construct
tccgcgagcagccgcccgta

SEQ ID NO: 726 - DNA, 20 bp, Artificial Sequence
  Synthetic construct
ccgcgagcagccgcccgtac

SEQ ID NO: 727 - DNA, 20 bp, Artificial Sequence
  Synthetic construct
cgcgagcagccgcccgtacg

SEQ ID NO: 728 - DNA, 20 bp, Artificial Sequence
  Synthetic construct
gcgagcagccgcccgtacgg

SEQ ID NO: 729 - DNA, 20 bp, Artificial Sequence
  Synthetic construct
cgagcagccgcccgtacgga

SEQ ID NO: 730 - DNA, 20 bp, Artificial Sequence
  Synthetic construct
gagcagccgcccgtacggag

SEQ ID NO: 731 - DNA, 20 bp, Artificial Sequence
  Synthetic construct
agcagccgcccgtacggagt

SEQ ID NO: 732 - DNA, 20 bp, Artificial Sequence
  Synthetic construct
gcagccgcccgtacggagtc

SEQ ID NO: 733 - DNA, 20 bp, Artificial Sequence
  Synthetic construct
cagccgcccgtacggagtct

SEQ ID NO: 734 - DNA, 20 bp, Artificial Sequence
  Synthetic construct
agccgcccgtacggagtctt

SEQ ID NO: 735 - DNA, 20 bp, Artificial Sequence
  Synthetic construct
gccgcccgtacggagtcttg

SEQ ID NO: 736 - DNA, 20 bp, Artificial Sequence
  Synthetic construct
ccgcccgtacggagtcttgg

SEQ ID NO: 737 - DNA, 20 bp, Artificial Sequence
  Synthetic construct
cgcccgtacggagtcttggt

SEQ ID NO: 738 - DNA, 20 bp, Artificial Sequence
  Synthetic construct
gcccgtacggagtcttggtg

SEQ ID NO: 739 - DNA, 20 bp, Artificial Sequence
  Synthetic construct
cccgtacggagtcttggtgt

SEQ ID NO: 740 - DNA, 20 bp, Artificial Sequence
  Synthetic construct
ccgtacggagtcttggtgta

SEQ ID NO: 741 - DNA, 20 bp, Artificial Sequence
  Synthetic construct
cgtacggagtcttggtgtat

SEQ ID NO: 742 - DNA, 20 bp, Artificial Sequence
  Synthetic construct
gtacggagtcttggtgtata

SEQ ID NO: 743 - DNA, 20 bp, Artificial Sequence
  Synthetic construct
tacggagtcttggtgtatac

SEQ ID NO: 744 - DNA, 20 bp, Artificial Sequence
  Synthetic construct
acggagtcttggtgtatacc

SEQ ID NO: 745 - DNA, 20 bp, Artificial Sequence
  Synthetic construct
cggagtcttggtgtataccg

SEQ ID NO: 746 - DNA, 20 bp, Artificial Sequence
  Synthetic construct
ggagtcttggtgtataccga

SEQ ID NO: 747 - DNA, 20 bp, Artificial Sequence
  Synthetic construct
gagtcttggtgtataccgag

SEQ ID NO: 748 - DNA, 20 bp, Artificial Sequence
  Synthetic construct
agtcttggtgtataccgaga

SEQ ID NO: 749 - DNA, 20 bp, Artificial Sequence
  Synthetic construct
gtcttggtgtataccgagac

SEQ ID NO: 750 - DNA, 20 bp, Artificial Sequence
  Synthetic construct
tcttggtgtataccgagact

SEQ ID NO: 751 - DNA, 20 bp, Artificial Sequence
  Synthetic construct
cttggtgtataccgagactg

SEQ ID NO: 752 - DNA, 20 bp, Artificial Sequence
  Synthetic construct
ttggtgtataccgagactgc

SEQ ID NO: 753 - DNA, 20 bp, Artificial Sequence
  Synthetic construct
tggtgtataccgagactgcc

SEQ ID NO: 754 - DNA, 20 bp, Artificial Sequence
  Synthetic construct
ggtgtataccgagactgccg

SEQ ID NO: 755 - DNA, 20 bp, Artificial Sequence
  Synthetic construct
gtgtataccgagactgccgt

SEQ ID NO: 756 - DNA, 20 bp, Artificial Sequence
  Synthetic construct
tgtataccgagactgccgta

SEQ ID NO: 757 - DNA, 20 bp, Artificial Sequence
  Synthetic construct
gtataccgagactgccgtag

SEQ ID NO: 758 - DNA, 20 bp, Artificial Sequence
  Synthetic construct
tataccgagactgccgtagg

SEQ ID NO: 759 - DNA, 20 bp, Artificial Sequence
  Synthetic construct
ataccgagactgccgtaggc

SEQ ID NO: 760 - DNA, 20 bp, Artificial Sequence
  Synthetic construct
taccgagactgccgtaggcg

SEQ ID NO: 761 - DNA, 20 bp, Artificial Sequence
  Synthetic construct
accgagactgccgtaggcgg

SEQ ID NO: 762 - DNA, 20 bp, Artificial Sequence
  Synthetic construct
ccgagactgccgtaggcggg

SEQ ID NO: 763 - DNA, 20 bp, Artificial Sequence
  Synthetic construct
cgagactgccgtaggcgggc

SEQ ID NO: 764 - DNA, 20 bp, Artificial Sequence
  Synthetic construct
gagactgccgtaggcgggct

SEQ ID NO: 765 - DNA, 20 bp, Artificial Sequence
  Synthetic construct
agactgccgtaggcgggctg

SEQ ID NO: 766 - DNA, 20 bp, Artificial Sequence
  Synthetic construct
gactgccgtaggcgggctga

SEQ ID NO: 767 - DNA, 20 bp, Artificial Sequence
  Synthetic construct
actgccgtaggcgggctgac

SEQ ID NO: 768 - DNA, 20 bp, Artificial Sequence
  Synthetic construct
ctgccgtaggcgggctgact

SEQ ID NO: 769 - DNA, 20 bp, Artificial Sequence
  Synthetic construct
tgccgtaggcgggctgacta

SEQ ID NO: 770 - DNA, 20 bp, Artificial Sequence
  Synthetic construct
gccgtaggcgggctgactac

SEQ ID NO: 771 - DNA, 20 bp, Artificial Sequence
  Synthetic construct
ccgtaggcgggctgactacg

SEQ ID NO: 772 - DNA, 20 bp, Artificial Sequence
  Synthetic construct
cgtaggcgggctgactacgt

SEQ ID NO: 773 - DNA, 20 bp, Artificial Sequence
  Synthetic construct
gtaggcgggctgactacgta

SEQ ID NO: 774 - DNA, 20 bp, Artificial Sequence
  Synthetic construct
taggcgggctgactacgtag

SEQ ID NO: 775 - DNA, 20 bp, Artificial Sequence
  Synthetic construct
aggcgggctgactacgtagt

SEQ ID NO: 776 - DNA, 20 bp, Artificial Sequence
  Synthetic construct
ggcgggctgactacgtagta

SEQ ID NO: 777 - DNA, 20 bp, Artificial Sequence
  Synthetic construct
gcgggctgactacgtagtag

SEQ ID NO: 778 - DNA, 20 bp, Artificial Sequence
  Synthetic construct
cgggctgactacgtagtagt

SEQ ID NO: 779 - DNA, 20 bp, Artificial Sequence
  Synthetic construct
gggctgactacgtagtagtc

SEQ ID NO: 780 - DNA, 20 bp, Artificial Sequence
  Synthetic construct
ggctgactacgtagtagtcg

SEQ ID NO: 781 - DNA, 20 bp, Artificial Sequence
  Synthetic construct
gctgactacgtagtagtcgg

SEQ ID NO: 782 - DNA, 20 bp, Artificial Sequence
  Synthetic construct
ctgactacgtagtagtcggc

SEQ ID NO: 783 - DNA, 20 bp, Artificial Sequence
  Synthetic construct
tgactacgtagtagtcggca

SEQ ID NO: 784 - DNA, 20 bp, Artificial Sequence
  Synthetic construct
gactacgtagtagtcggcag

SEQ ID NO: 785 - DNA, 20 bp, Artificial Sequence
  Synthetic construct
actacgtagtagtcggcagc

SEQ ID NO: 786 - DNA, 20 bp, Artificial Sequence
  Synthetic construct
ctacgtagtagtcggcagcg

SEQ ID NO: 787 - DNA, 20 bp, Artificial Sequence
  Synthetic construct
tacgtagtagtcggcagcga

SEQ ID NO: 788 - DNA, 20 bp, Artificial Sequence
  Synthetic construct
acgtagtagtcggcagcgag

SEQ ID NO: 789 - DNA, 20 bp, Artificial Sequence
  Synthetic construct
cgtagtagtcggcagcgagg

SEQ ID NO: 790 - DNA, 20 bp, Artificial Sequence
  Synthetic construct
gtagtagtcggcagcgaggt

SEQ ID NO: 791 - DNA, 20 bp, Artificial Sequence
  Synthetic construct
tagtagtcggcagcgaggtc

SEQ ID NO: 792 - DNA, 20 bp, Artificial Sequence
  Synthetic construct
agtagtcggcagcgaggtcc

SEQ ID NO: 793 - DNA, 20 bp, Artificial Sequence
  Synthetic construct
gtagtcggcagcgaggtccg

SEQ ID NO: 794 - DNA, 20 bp, Artificial Sequence
  Synthetic construct
tagtcggcagcgaggtccgt

SEQ ID NO: 795 - DNA, 20 bp, Artificial Sequence
  Synthetic construct
agtcggcagcgaggtccgtc

SEQ ID NO: 796 - DNA, 20 bp, Artificial Sequence
  Synthetic construct
gtcggcagcgaggtccgtcc

SEQ ID NO: 797 - DNA, 20 bp, Artificial Sequence
  Synthetic construct
tcggcagcgaggtccgtccc

SEQ ID NO: 798 - DNA, 20 bp, Artificial Sequence
  Synthetic construct
cggcagcgaggtccgtccca

SEQ ID NO: 799 - DNA, 20 bp, Artificial Sequence
  Synthetic construct
ggcagcgaggtccgtcccac

SEQ ID NO: 800 - DNA, 20 bp, Artificial Sequence
  Synthetic construct
gcagcgaggtccgtcccacc

SEQ ID NO: 801 - DNA, 20 bp, Artificial Sequence
  Synthetic construct
cagcgaggtccgtcccaccg

SEQ ID NO: 802 - DNA, 20 bp, Artificial Sequence
  Synthetic construct
agcgaggtccgtcccaccga

SEQ ID NO: 803 - DNA, 20 bp, Artificial Sequence
  Synthetic construct
gcgaggtccgtcccaccgaa

SEQ ID NO: 804 - DNA, 20 bp, Artificial Sequence
  Synthetic construct
cgaggtccgtcccaccgaag

SEQ ID NO: 805 - DNA, 20 bp, Artificial Sequence
  Synthetic construct
gaggtccgtcccaccgaaga

SEQ ID NO: 806 - DNA, 20 bp, Artificial Sequence
  Synthetic construct
aggtccgtcccaccgaagaa

SEQ ID NO: 807 - DNA, 20 bp, Artificial Sequence
  Synthetic construct
ggtccgtcccaccgaagaac

SEQ ID NO: 808 - DNA, 20 bp, Artificial Sequence
  Synthetic construct
gtccgtcccaccgaagaaca

SEQ ID NO: 809 - DNA, 20 bp, Artificial Sequence
  Synthetic construct
tccgtcccaccgaagaacat

SEQ ID NO: 810 - DNA, 20 bp, Artificial Sequence
  Synthetic construct
ccgtcccaccgaagaacatc

SEQ ID NO: 811 - DNA, 20 bp, Artificial Sequence
  Synthetic construct
cgtcccaccgaagaacatcg

SEQ ID NO: 812 - DNA, 20 bp, Artificial Sequence
  Synthetic construct
gtcccaccgaagaacatcga

SEQ ID NO: 813 - DNA, 20 bp, Artificial Sequence
  Synthetic construct
tcccaccgaagaacatcgaa

SEQ ID NO: 814 - DNA, 20 bp, Artificial Sequence
  Synthetic construct
cccaccgaagaacatcgaag

SEQ ID NO: 815 - DNA, 20 bp, Artificial Sequence
  Synthetic construct
ccaccgaagaacatcgaagg

SEQ ID NO: 816 - DNA, 20 bp, Artificial Sequence
  Synthetic construct
caccgaagaacatcgaaggc

SEQ ID NO: 817 - DNA, 20 bp, Artificial Sequence
  Synthetic construct
accgaagaacatcgaaggca

SEQ ID NO: 818 - DNA, 20 bp, Artificial Sequence
  Synthetic construct
ccgaagaacatcgaaggcac

SEQ ID NO: 819 - DNA, 20 bp, Artificial Sequence
  Synthetic construct
cgaagaacatcgaaggcacc

SEQ ID NO: 820 - DNA, 20 bp, Artificial Sequence
  Synthetic construct
gaagaacatcgaaggcacct

SEQ ID NO: 821 - DNA, 20 bp, Artificial Sequence
  Synthetic construct
aagaacatcgaaggcacctg

SEQ ID NO: 822 - DNA, 20 bp, Artificial Sequence
  Synthetic construct
agaacatcgaaggcacctgg

SEQ ID NO: 823 - DNA, 20 bp, Artificial Sequence
  Synthetic construct
gaacatcgaaggcacctggg

SEQ ID NO: 824 - DNA, 20 bp, Artificial Sequence
  Synthetic construct
aacatcgaaggcacctggga

SEQ ID NO: 825 - DNA, 20 bp, Artificial Sequence
  Synthetic construct
acatcgaaggcacctgggag

SEQ ID NO: 826 - DNA, 20 bp, Artificial Sequence
  Synthetic construct
catcgaaggcacctgggagg

SEQ ID NO: 827 - DNA, 20 bp, Artificial Sequence
  Synthetic construct
atcgaaggcacctgggagga

SEQ ID NO: 828 - DNA, 20 bp, Artificial Sequence
  Synthetic construct
tcgaaggcacctgggaggag

SEQ ID NO: 829 - DNA, 20 bp, Artificial Sequence
  Synthetic construct
cgaaggcacctgggaggaga

SEQ ID NO: 830 - DNA, 20 bp, Artificial Sequence
  Synthetic construct
gaaggcacctgggaggagag

SEQ ID NO: 831 - DNA, 20 bp, Artificial Sequence
  Synthetic construct
aaggcacctgggaggagagc

SEQ ID NO: 832 - DNA, 20 bp, Artificial Sequence
  Synthetic construct
aggcacctgggaggagagcc

SEQ ID NO: 833 - DNA, 20 bp, Artificial Sequence
  Synthetic construct
ggcacctgggaggagagccg

SEQ ID NO: 834 - DNA, 20 bp, Artificial Sequence
  Synthetic construct
gcacctgggaggagagccgt

SEQ ID NO: 835 - DNA, 20 bp, Artificial Sequence
  Synthetic construct
cacctgggaggagagccgta

SEQ ID NO: 836 - DNA, 20 bp, Artificial Sequence
  Synthetic construct
acctgggaggagagccgtac

SEQ ID NO: 837 - DNA, 20 bp, Artificial Sequence
  Synthetic construct
cctgggaggagagccgtacc

SEQ ID NO: 838 - DNA, 20 bp, Artificial Sequence
  Synthetic construct
ctgggaggagagccgtaccc

SEQ ID NO: 839 - DNA, 20 bp, Artificial Sequence
  Synthetic construct
tgggaggagagccgtaccca

SEQ ID NO: 840 - DNA, 20 bp, Artificial Sequence
  Synthetic construct
gggaggagagccgtacccac

SEQ ID NO: 841 - DNA, 20 bp, Artificial Sequence
  Synthetic construct
ggaggagagccgtacccaca

SEQ ID NO: 842 - DNA, 20 bp, Artificial Sequence
  Synthetic construct
gaggagagccgtacccacac

SEQ ID NO: 843 - DNA, 20 bp, Artificial Sequence
  Synthetic construct
aggagagccgtacccacacc

SEQ ID NO: 844 - DNA, 20 bp, Artificial Sequence
  Synthetic construct
ggagagccgtacccacacct

SEQ ID NO: 845 - DNA, 20 bp, Artificial Sequence
  Synthetic construct
gagagccgtacccacacctt

SEQ ID NO: 846 - DNA, 20 bp, Artificial Sequence
  Synthetic construct
agagccgtacccacacctta

SEQ ID NO: 847 - DNA, 20 bp, Artificial Sequence
  Synthetic construct
gagccgtacccacaccttat

SEQ ID NO: 848 - DNA, 20 bp, Artificial Sequence
  Synthetic construct
agccgtacccacaccttata

SEQ ID NO: 849 - DNA, 20 bp, Artificial Sequence
  Synthetic construct
gccgtacccacaccttatag

SEQ ID NO: 850 - DNA, 20 bp, Artificial Sequence
  Synthetic construct
ccgtacccacaccttataga

SEQ ID NO: 851 - DNA, 20 bp, Artificial Sequence
  Synthetic construct
cgtacccacaccttatagag

SEQ ID NO: 852 - DNA, 20 bp, Artificial Sequence
  Synthetic construct
gtacccacaccttatagagg

SEQ ID NO: 853 - DNA, 20 bp, Artificial Sequence
  Synthetic construct
tacccacaccttatagaggc

SEQ ID NO: 854 - DNA, 20 bp, Artificial Sequence
  Synthetic construct
acccacaccttatagaggcg

SEQ ID NO: 855 - DNA, 20 bp, Artificial Sequence
  Synthetic construct
cccacaccttatagaggcgt

SEQ ID NO: 856 - DNA, 20 bp, Artificial Sequence
  Synthetic construct
ccacaccttatagaggcgtg

SEQ ID NO: 857 - DNA, 20 bp, Artificial Sequence
  Synthetic construct
cacaccttatagaggcgtgg

SEQ ID NO: 858 - DNA, 20 bp, Artificial Sequence
  Synthetic construct
acaccttatagaggcgtgga

SEQ ID NO: 859 - DNA, 20 bp, Artificial Sequence
  Synthetic construct
caccttatagaggcgtggat

SEQ ID NO: 860 - DNA, 20 bp, Artificial Sequence
  Synthetic construct
accttatagaggcgtggatc

SEQ ID NO: 861 - DNA, 20 bp, Artificial Sequence
  Synthetic construct
ccttatagaggcgtggatct

SEQ ID NO: 862 - DNA, 20 bp, Artificial Sequence
  Synthetic construct
cttatagaggcgtggatctg

SEQ ID NO: 863 - DNA, 20 bp, Artificial Sequence
  Synthetic construct
ttatagaggcgtggatctga

SEQ ID NO: 864 - DNA, 20 bp, Artificial Sequence
  Synthetic construct
tatagaggcgtggatctgac

SEQ ID NO: 865 - DNA, 20 bp, Artificial Sequence
  Synthetic construct
atagaggcgtggatctgaca

SEQ ID NO: 866 - DNA, 20 bp, Artificial Sequence
  Synthetic construct
tagaggcgtggatctgacat

SEQ ID NO: 867 - DNA, 20 bp, Artificial Sequence
  Synthetic construct
agaggcgtggatctgacata

SEQ ID NO: 868 - DNA, 20 bp, Artificial Sequence
  Synthetic construct
gaggcgtggatctgacatac

SEQ ID NO: 869 - DNA, 20 bp, Artificial Sequence
  Synthetic construct
aggcgtggatctgacatacc

SEQ ID NO: 870 - DNA, 20 bp, Artificial Sequence
  Synthetic construct
ggcgtggatctgacatacct

SEQ ID NO: 871 - DNA, 20 bp, Artificial Sequence
  Synthetic construct
gcgtggatctgacatacctc

SEQ ID NO: 872 - DNA, 20 bp, Artificial Sequence
  Synthetic construct
cgtggatctgacatacctcc

SEQ ID NO: 873 - DNA, 20 bp, Artificial Sequence
  Synthetic construct
gtggatctgacatacctccg

SEQ ID NO: 874 - DNA, 20 bp, Artificial Sequence
  Synthetic construct
tggatctgacatacctccga

SEQ ID NO: 875 - DNA, 20 bp, Artificial Sequence
  Synthetic construct
ggatctgacatacctccgac

SEQ ID NO: 876 - DNA, 20 bp, Artificial Sequence
  Synthetic construct
gatctgacatacctccgaca

SEQ ID NO: 877 - DNA, 20 bp, Artificial Sequence
  Synthetic construct
atctgacatacctccgacaa

SEQ ID NO: 878 - DNA, 20 bp, Artificial Sequence
  Synthetic construct
tctgacatacctccgacaac

SEQ ID NO: 879 - DNA, 20 bp, Artificial Sequence
  Synthetic construct
ctgacatacctccgacaact

SEQ ID NO: 880 - DNA, 20 bp, Artificial Sequence
  Synthetic construct
tgacatacctccgacaactc

SEQ ID NO: 881 - DNA, 20 bp, Artificial Sequence
  Synthetic construct
gacatacctccgacaactcc

SEQ ID NO: 882 - DNA, 20 bp, Artificial Sequence
  Synthetic construct
acatacctccgacaactccc

SEQ ID NO: 883 - DNA, 20 bp, Artificial Sequence
  Synthetic construct
catacctccgacaactcccc

SEQ ID NO: 884 - DNA, 20 bp, Artificial Sequence
  Synthetic construct
atacctccgacaactcccca

SEQ ID NO: 885 - DNA, 20 bp, Artificial Sequence
  Synthetic construct
tacctccgacaactccccaa

SEQ ID NO: 886 - DNA, 20 bp, Artificial Sequence
  Synthetic construct
acctccgacaactccccaac

SEQ ID NO: 887 - DNA, 20 bp, Artificial Sequence
  Synthetic construct
cctccgacaactccccaacc

SEQ ID NO: 888 - DNA, 20 bp, Artificial Sequence
  Synthetic construct
ctccgacaactccccaaccc

SEQ ID NO: 889 - DNA, 20 bp, Artificial Sequence
  Synthetic construct
tccgacaactccccaacccc

SEQ ID NO: 890 - DNA, 20 bp, Artificial Sequence
  Synthetic construct
ccgacaactccccaaccccg

SEQ ID NO: 891 - DNA, 20 bp, Artificial Sequence
  Synthetic construct
cgacaactccccaaccccgt

SEQ ID NO: 892 - DNA, 20 bp, Artificial Sequence
  Synthetic construct
gacaactccccaaccccgta

SEQ ID NO: 893 - DNA, 20 bp, Artificial Sequence
  Synthetic construct
acaactccccaaccccgtag

SEQ ID NO: 894 - DNA, 20 bp, Artificial Sequence
  Synthetic construct
caactccccaaccccgtagc

SEQ ID NO: 895 - DNA, 20 bp, Artificial Sequence
  Synthetic construct
aactccccaaccccgtagcc

SEQ ID NO: 896 - DNA, 20 bp, Artificial Sequence
  Synthetic construct
actccccaaccccgtagccg

SEQ ID NO: 897 - DNA, 20 bp, Artificial Sequence
  Synthetic construct
ctccccaaccccgtagccga

SEQ ID NO: 898 - DNA, 20 bp, Artificial Sequence
  Synthetic construct
tccccaaccccgtagccgat

SEQ ID NO: 899 - DNA, 20 bp, Artificial Sequence
  Synthetic construct
ccccaaccccgtagccgatt

SEQ ID NO: 900 - DNA, 20 bp, Artificial Sequence
  Synthetic construct
cccaaccccgtagccgattt

SEQ ID NO: 901 - DNA, 20 bp, Artificial Sequence
  Synthetic construct
ccaaccccgtagccgattta

SEQ ID NO: 902 - DNA, 20 bp, Artificial Sequence
  Synthetic construct
caaccccgtagccgatttaa

SEQ ID NO: 903 - DNA, 20 bp, Artificial Sequence
  Synthetic construct
aaccccgtagccgatttaat

SEQ ID NO: 904 - DNA, 20 bp, Artificial Sequence
  Synthetic construct
accccgtagccgatttaata

SEQ ID NO: 905 - DNA, 20 bp, Artificial Sequence
  Synthetic construct
ccccgtagccgatttaatat

SEQ ID NO: 906 - DNA, 20 bp, Artificial Sequence
  Synthetic construct
cccgtagccgatttaatatc

SEQ ID NO: 907 - DNA, 20 bp, Artificial Sequence
  Synthetic construct
ccgtagccgatttaatatca

SEQ ID NO: 908 - DNA, 20 bp, Artificial Sequence
  Synthetic construct
cgtagccgatttaatatcag

SEQ ID NO: 909 - DNA, 20 bp, Artificial Sequence
  Synthetic construct
gtagccgatttaatatcagc

SEQ ID NO: 910 - DNA, 20 bp, Artificial Sequence
  Synthetic construct
tagccgatttaatatcagca

SEQ ID NO: 911 - DNA, 20 bp, Artificial Sequence
  Synthetic construct
agccgatttaatatcagcat

SEQ ID NO: 912 - DNA, 20 bp, Artificial Sequence
  Synthetic construct
gccgatttaatatcagcatc

SEQ ID NO: 913 - DNA, 20 bp, Artificial Sequence
  Synthetic construct
ccgatttaatatcagcatca

SEQ ID NO: 914 - DNA, 20 bp, Artificial Sequence
  Synthetic construct
cgatttaatatcagcatcag

SEQ ID NO: 915 - DNA, 20 bp, Artificial Sequence
  Synthetic construct
gatttaatatcagcatcagg

SEQ ID NO: 916 - DNA, 20 bp, Artificial Sequence
  Synthetic construct
atttaatatcagcatcaggg

SEQ ID NO: 917 - DNA, 20 bp, Artificial Sequence
  Synthetic construct
tttaatatcagcatcagggc

SEQ ID NO: 918 - DNA, 20 bp, Artificial Sequence
  Synthetic construct
ttaatatcagcatcagggcg

SEQ ID NO: 919 - DNA, 20 bp, Artificial Sequence
  Synthetic construct
taatatcagcatcagggcga

SEQ ID NO: 920 - DNA, 20 bp, Artificial Sequence
  Synthetic construct
aatatcagcatcagggcgaa

SEQ ID NO: 921 - DNA, 20 bp, Artificial Sequence
  Synthetic construct
atatcagcatcagggcgaag

SEQ ID NO: 922 - DNA, 20 bp, Artificial Sequence
  Synthetic construct
tatcagcatcagggcgaaga

SEQ ID NO: 923 - DNA, 20 bp, Artificial Sequence
  Synthetic construct
atcagcatcagggcgaagag

SEQ ID NO: 924 - DNA, 20 bp, Artificial Sequence
  Synthetic construct
tcagcatcagggcgaagaga

SEQ ID NO: 925 - DNA, 20 bp, Artificial Sequence
  Synthetic construct
cagcatcagggcgaagagat

SEQ ID NO: 926 - DNA, 20 bp, Artificial Sequence
  Synthetic construct
agcatcagggcgaagagatt

SEQ ID NO: 927 - DNA, 20 bp, Artificial Sequence
  Synthetic construct
gcatcagggcgaagagattg

SEQ ID NO: 928 - DNA, 20 bp, Artificial Sequence
  Synthetic construct
catcagggcgaagagattgt

SEQ ID NO: 929 - DNA, 20 bp, Artificial Sequence
  Synthetic construct
atcagggcgaagagattgtc

SEQ ID NO: 930 - DNA, 20 bp, Artificial Sequence
  Synthetic construct
tcagggcgaagagattgtca

SEQ ID NO: 931 - DNA, 20 bp, Artificial Sequence
  Synthetic construct
cagggcgaagagattgtcaa

SEQ ID NO: 932 - DNA, 20 bp, Artificial Sequence
  Synthetic construct
agggcgaagagattgtcaac

SEQ ID NO: 933 - DNA, 20 bp, Artificial Sequence
  Synthetic construct
gggcgaagagattgtcaaca

SEQ ID NO: 934 - DNA, 20 bp, Artificial Sequence
  Synthetic construct
ggcgaagagattgtcaacag

SEQ ID NO: 935 - DNA, 20 bp, Artificial Sequence
  Synthetic construct
gcgaagagattgtcaacagg

SEQ ID NO: 936 - DNA, 20 bp, Artificial Sequence
  Synthetic construct
cgaagagattgtcaacaggt

SEQ ID NO: 937 - DNA, 20 bp, Artificial Sequence
  Synthetic construct
gaagagattgtcaacaggtt

SEQ ID NO: 938 - DNA, 20 bp, Artificial Sequence
  Synthetic construct
aagagattgtcaacaggttt

SEQ ID NO: 939 - DNA, 20 bp, Artificial Sequence
  Synthetic construct
agagattgtcaacaggtttc

SEQ ID NO: 940 - DNA, 20 bp, Artificial Sequence
  Synthetic construct
gagattgtcaacaggtttct

SEQ ID NO: 941 - DNA, 20 bp, Artificial Sequence
  Synthetic construct
agattgtcaacaggtttctt

SEQ ID NO: 942 - DNA, 20 bp, Artificial Sequence
  Synthetic construct
gattgtcaacaggtttcttg

SEQ ID NO: 943 - DNA, 20 bp, Artificial Sequence
  Synthetic construct
attgtcaacaggtttcttga

SEQ ID NO: 944 - DNA, 20 bp, Artificial Sequence
  Synthetic construct
ttgtcaacaggtttcttgat

SEQ ID NO: 945 - DNA, 20 bp, Artificial Sequence
  Synthetic construct
tgtcaacaggtttcttgatg

SEQ ID NO: 946 - DNA, 20 bp, Artificial Sequence
  Synthetic construct
gtcaacaggtttcttgatgt

SEQ ID NO: 947 - DNA, 20 bp, Artificial Sequence
  Synthetic construct
tcaacaggtttcttgatgta

SEQ ID NO: 948 - DNA, 20 bp, Artificial Sequence
  Synthetic construct
caacaggtttcttgatgtaa

SEQ ID NO: 949 - DNA, 20 bp, Artificial Sequence
  Synthetic construct
aacaggtttcttgatgtaaa

SEQ ID NO: 950 - DNA, 20 bp, Artificial Sequence
  Synthetic construct
acaggtttcttgatgtaaaa

SEQ ID NO: 951 - DNA, 20 bp, Artificial Sequence
  Synthetic construct
caggtttcttgatgtaaaac

SEQ ID NO: 952 - DNA, 20 bp, Artificial Sequence
  Synthetic construct
aggtttcttgatgtaaaacg

SEQ ID NO: 953 - DNA, 20 bp, Artificial Sequence
  Synthetic construct
ggtttcttgatgtaaaacgg

SEQ ID NO: 954 - DNA, 20 bp, Artificial Sequence
  Synthetic construct
gtttcttgatgtaaaacggt

SEQ ID NO: 955 - DNA, 20 bp, Artificial Sequence
  Synthetic construct
tttcttgatgtaaaacggtt

SEQ ID NO: 956 - DNA, 20 bp, Artificial Sequence
  Synthetic construct
ttcttgatgtaaaacggttt

SEQ ID NO: 957 - DNA, 20 bp, Artificial Sequence
  Synthetic construct
tcttgatgtaaaacggtttg

SEQ ID NO: 958 - DNA, 20 bp, Artificial Sequence
  Synthetic construct
cttgatgtaaaacggtttga

SEQ ID NO: 959 - DNA, 20 bp, Artificial Sequence
  Synthetic construct
ttgatgtaaaacggtttgac

SEQ ID NO: 960 - DNA, 20 bp, Artificial Sequence
  Synthetic construct
tgatgtaaaacggtttgaca

SEQ ID NO: 961 - DNA, 20 bp, Artificial Sequence
  Synthetic construct
gatgtaaaacggtttgacat

SEQ ID NO: 962 - DNA, 20 bp, Artificial Sequence
  Synthetic construct
atgtaaaacggtttgacatc

SEQ ID NO: 963 - DNA, 20 bp, Artificial Sequence
  Synthetic construct
tgtaaaacggtttgacatcg

SEQ ID NO: 964 - DNA, 20 bp, Artificial Sequence
  Synthetic construct
gtaaaacggtttgacatcga

SEQ ID NO: 965 - DNA, 20 bp, Artificial Sequence
  Synthetic construct
taaaacggtttgacatcgac

SEQ ID NO: 966 - DNA, 20 bp, Artificial Sequence
  Synthetic construct
aaaacggtttgacatcgaca

SEQ ID NO: 967 - DNA, 20 bp, Artificial Sequence
  Synthetic construct
aaacggtttgacatcgacac

SEQ ID NO: 968 - DNA, 20 bp, Artificial Sequence
  Synthetic construct
aacggtttgacatcgacacc

SEQ ID NO: 969 - DNA, 20 bp, Artificial Sequence
  Synthetic construct
acggtttgacatcgacacca

SEQ ID NO: 970 - DNA, 20 bp, Artificial Sequence
  Synthetic construct
cggtttgacatcgacaccac

SEQ ID NO: 971 - DNA, 20 bp, Artificial Sequence
  Synthetic construct
ggtttgacatcgacaccacg

SEQ ID NO: 972 - DNA, 20 bp, Artificial Sequence
  Synthetic construct
gtttgacatcgacaccacgg

SEQ ID NO: 973 - DNA, 20 bp, Artificial Sequence
  Synthetic construct
tttgacatcgacaccacggt

SEQ ID NO: 974 - DNA, 20 bp, Artificial Sequence
  Synthetic construct
ttgacatcgacaccacggta

SEQ ID NO: 975 - DNA, 20 bp, Artificial Sequence
  Synthetic construct
tgacatcgacaccacggtaa

SEQ ID NO: 976 - DNA, 20 bp, Artificial Sequence
  Synthetic construct
gacatcgacaccacggtaaa

SEQ ID NO: 977 - DNA, 20 bp, Artificial Sequence
  Synthetic construct
acatcgacaccacggtaaaa

SEQ ID NO: 978 - DNA, 20 bp, Artificial Sequence
  Synthetic construct
catcgacaccacggtaaaag

SEQ ID NO: 979 - DNA, 20 bp, Artificial Sequence
  Synthetic construct
atcgacaccacggtaaaagt

SEQ ID NO: 980 - DNA, 20 bp, Artificial Sequence
  Synthetic construct
tcgacaccacggtaaaagtg

SEQ ID NO: 981 - DNA, 20 bp, Artificial Sequence
  Synthetic construct
cgacaccacggtaaaagtgc

SEQ ID NO: 982 - DNA, 20 bp, Artificial Sequence
  Synthetic construct
gacaccacggtaaaagtgcg

SEQ ID NO: 983 - DNA, 20 bp, Artificial Sequence
  Synthetic construct
acaccacggtaaaagtgcgc

SEQ ID NO: 984 - DNA, 20 bp, Artificial Sequence
  Synthetic construct
caccacggtaaaagtgcgcg

SEQ ID NO: 985 - DNA, 20 bp, Artificial Sequence
  Synthetic construct
accacggtaaaagtgcgcgc

SEQ ID NO: 986 - DNA, 20 bp, Artificial Sequence
  Synthetic construct
ccacggtaaaagtgcgcgcc

SEQ ID NO: 987 - DNA, 20 bp, Artificial Sequence
  Synthetic construct
cacggtaaaagtgcgcgccg

SEQ ID NO: 988 - DNA, 20 bp, Artificial Sequence
  Synthetic construct
acggtaaaagtgcgcgccgc

SEQ ID NO: 989 - DNA, 20 bp, Artificial Sequence
  Synthetic construct
cggtaaaagtgcgcgccgca

SEQ ID NO: 990 - DNA, 20 bp, Artificial Sequence
  Synthetic construct
ggtaaaagtgcgcgccgcag

SEQ ID NO: 991 - DNA, 20 bp, Artificial Sequence
  Synthetic construct
gtaaaagtgcgcgccgcagc

SEQ ID NO: 992 - DNA, 20 bp, Artificial Sequence
  Synthetic construct
taaaagtgcgcgccgcagct

SEQ ID NO: 993 - DNA, 20 bp, Artificial Sequence
  Synthetic construct
aaaagtgcgcgccgcagctc

SEQ ID NO: 994 - DNA, 20 bp, Artificial Sequence
  Synthetic construct
aaagtgcgcgccgcagctct

SEQ ID NO: 995 - DNA, 20 bp, Artificial Sequence
  Synthetic construct
aagtgcgcgccgcagctctc

SEQ ID NO: 996 - DNA, 20 bp, Artificial Sequence
  Synthetic construct
agtgcgcgccgcagctctcg

SEQ ID NO: 997 - DNA, 20 bp, Artificial Sequence
  Synthetic construct
gtgcgcgccgcagctctcgc

SEQ ID NO: 998 - DNA, 20 bp, Artificial Sequence
  Synthetic construct
tgcgcgccgcagctctcgcg

SEQ ID NO: 999 - DNA, 20 bp, Artificial Sequence
  Synthetic construct
gcgcgccgcagctctcgcga

SEQ ID NO: 1000 - DNA, 20 bp, Artificial Sequence
  Synthetic construct
cgcgccgcagctctcgcgaa

SEQ ID NO: 1001 - DNA, 20 bp, Artificial Sequence
  Synthetic construct
gcgccgcagctctcgcgaaa

SEQ ID NO: 1002 - DNA, 20 bp, Artificial Sequence
  Synthetic construct
cgccgcagctctcgcgaaag

SEQ ID NO: 1003 - DNA, 20 bp, Artificial Sequence
  Synthetic construct
gccgcagctctcgcgaaaga

SEQ ID NO: 1004 - DNA, 20 bp, Artificial Sequence
  Synthetic construct
ccgcagctctcgcgaaagag

SEQ ID NO: 1005 - DNA, 20 bp, Artificial Sequence
  Synthetic construct
cgcagctctcgcgaaagagc

SEQ ID NO: 1006 - DNA, 20 bp, Artificial Sequence
  Synthetic construct
gcagctctcgcgaaagagcc

SEQ ID NO: 1007 - DNA, 20 bp, Artificial Sequence
  Synthetic construct
cagctctcgcgaaagagccc

SEQ ID NO: 1008 - DNA, 20 bp, Artificial Sequence
  Synthetic construct
agctctcgcgaaagagcccg

SEQ ID NO: 1009 - DNA, 20 bp, Artificial Sequence
  Synthetic construct
gctctcgcgaaagagcccgg

SEQ ID NO: 1010 - DNA, 20 bp, Artificial Sequence
  Synthetic construct
ctctcgcgaaagagcccgga

SEQ ID NO: 1011 - DNA, 20 bp, Artificial Sequence
  Synthetic construct
tctcgcgaaagagcccggac

SEQ ID NO: 1012 - DNA, 20 bp, Artificial Sequence
  Synthetic construct
ctcgcgaaagagcccggaca

SEQ ID NO: 1013 - DNA, 20 bp, Artificial Sequence
  Synthetic construct
tcgcgaaagagcccggacac

SEQ ID NO: 1014 - DNA, 20 bp, Artificial Sequence
  Synthetic construct
cgcgaaagagcccggacacg

SEQ ID NO: 1015 - DNA, 20 bp, Artificial Sequence
  Synthetic construct
gcgaaagagcccggacacga

SEQ ID NO: 1016 - DNA, 20 bp, Artificial Sequence
  Synthetic construct
cgaaagagcccggacacgaa

SEQ ID NO: 1017 - DNA, 20 bp, Artificial Sequence
  Synthetic construct
gaaagagcccggacacgaac

SEQ ID NO: 1018 - DNA, 20 bp, Artificial Sequence
  Synthetic construct
aaagagcccggacacgaacg

SEQ ID NO: 1019 - DNA, 20 bp, Artificial Sequence
  Synthetic construct
aagagcccggacacgaacgt

SEQ ID NO: 1020 - DNA, 20 bp, Artificial Sequence
  Synthetic construct
agagcccggacacgaacgtt

SEQ ID NO: 1021 - DNA, 20 bp, Artificial Sequence
  Synthetic construct
gagcccggacacgaacgttt

SEQ ID NO: 1022 - DNA, 20 bp, Artificial Sequence
  Synthetic construct
agcccggacacgaacgtttt

SEQ ID NO: 1023 - DNA, 20 bp, Artificial Sequence
  Synthetic construct
gcccggacacgaacgtttta

SEQ ID NO: 1024 - DNA, 20 bp, Artificial Sequence
  Synthetic construct
cccggacacgaacgttttac

SEQ ID NO: 1025 - DNA, 20 bp, Artificial Sequence
  Synthetic construct
ccggacacgaacgttttacg

SEQ ID NO: 1026 - DNA, 20 bp, Artificial Sequence
  Synthetic construct
cggacacgaacgttttacga

SEQ ID NO: 1027 - DNA, 20 bp, Artificial Sequence
  Synthetic construct
ggacacgaacgttttacgaa

SEQ ID NO: 1028 - DNA, 20 bp, Artificial Sequence
  Synthetic construct
gacacgaacgttttacgaag

SEQ ID NO: 1029 - DNA, 20 bp, Artificial Sequence
  Synthetic construct
acacgaacgttttacgaaga

SEQ ID NO: 1030 - DNA, 20 bp, Artificial Sequence
  Synthetic construct
cacgaacgttttacgaagat

SEQ ID NO: 1031 - DNA, 20 bp, Artificial Sequence
  Synthetic construct
acgaacgttttacgaagatt

SEQ ID NO: 1032 - DNA, 20 bp, Artificial Sequence
  Synthetic construct
cgaacgttttacgaagattc

SEQ ID NO: 1033 - DNA, 20 bp, Artificial Sequence
  Synthetic construct
gaacgttttacgaagattcg

SEQ ID NO: 1034 - DNA, 20 bp, Artificial Sequence
  Synthetic construct
aacgttttacgaagattcgg

SEQ ID NO: 1035 - DNA, 20 bp, Artificial Sequence
  Synthetic construct
acgttttacgaagattcggt

SEQ ID NO: 1036 - DNA, 20 bp, Artificial Sequence
  Synthetic construct
cgttttacgaagattcggtt

SEQ ID NO: 1037 - DNA, 20 bp, Artificial Sequence
  Synthetic construct
gttttacgaagattcggttt

SEQ ID NO: 1038 - DNA, 20 bp, Artificial Sequence
  Synthetic construct
ttttacgaagattcggttta

SEQ ID NO: 1039 - DNA, 20 bp, Artificial Sequence
  Synthetic construct
tttacgaagattcggtttaa

SEQ ID NO: 1040 - DNA, 20 bp, Artificial Sequence
  Synthetic construct
ttacgaagattcggtttaaa

SEQ ID NO: 1041 - DNA, 20 bp, Artificial Sequence
  Synthetic construct
tacgaagattcggtttaaaa

SEQ ID NO: 1042 - DNA, 20 bp, Artificial Sequence
  Synthetic construct
acgaagattcggtttaaaac

SEQ ID NO: 1043 - DNA, 20 bp, Artificial Sequence
  Synthetic construct
cgaagattcggtttaaaacc

SEQ ID NO: 1044 - DNA, 20 bp, Artificial Sequence
  Synthetic construct
gaagattcggtttaaaaccg

SEQ ID NO: 1045 - DNA, 20 bp, Artificial Sequence
  Synthetic construct
aagattcggtttaaaaccgt

SEQ ID NO: 1046 - DNA, 20 bp, Artificial Sequence
  Synthetic construct
agattcggtttaaaaccgta

SEQ ID NO: 1047 - DNA, 20 bp, Artificial Sequence
  Synthetic construct
gattcggtttaaaaccgtag

SEQ ID NO: 1048 - DNA, 20 bp, Artificial Sequence
  Synthetic construct
attcggtttaaaaccgtagt

SEQ ID NO: 1049 - DNA, 20 bp, Artificial Sequence
  Synthetic construct
ttcggtttaaaaccgtagta

SEQ ID NO: 1050 - DNA, 20 bp, Artificial Sequence
  Synthetic construct
tcggtttaaaaccgtagtag

SEQ ID NO: 1051 - DNA, 20 bp, Artificial Sequence
  Synthetic construct
cggtttaaaaccgtagtagg

SEQ ID NO: 1052 - DNA, 20 bp, Artificial Sequence
  Synthetic construct
ggtttaaaaccgtagtaggc

SEQ ID NO: 1053 - DNA, 20 bp, Artificial Sequence
  Synthetic construct
gtttaaaaccgtagtaggca

SEQ ID NO: 1054 - DNA, 20 bp, Artificial Sequence
  Synthetic construct
tttaaaaccgtagtaggcaa

SEQ ID NO: 1055 - DNA, 20 bp, Artificial Sequence
  Synthetic construct
ttaaaaccgtagtaggcaag

SEQ ID NO: 1056 - DNA, 20 bp, Artificial Sequence
  Synthetic construct
taaaaccgtagtaggcaagt

SEQ ID NO: 1057 - DNA, 20 bp, Artificial Sequence
  Synthetic construct
aaaaccgtagtaggcaagtg

SEQ ID NO: 1058 - DNA, 20 bp, Artificial Sequence
  Synthetic construct
aaaccgtagtaggcaagtgc

SEQ ID NO: 1059 - DNA, 20 bp, Artificial Sequence
  Synthetic construct
aaccgtagtaggcaagtgcc

SEQ ID NO: 1060 - DNA, 20 bp, Artificial Sequence
  Synthetic construct
accgtagtaggcaagtgcct

SEQ ID NO: 1061 - DNA, 20 bp, Artificial Sequence
  Synthetic construct
ccgtagtaggcaagtgcctc

SEQ ID NO: 1062 - DNA, 20 bp, Artificial Sequence
  Synthetic construct
cgtagtaggcaagtgcctct

SEQ ID NO: 1063 - DNA, 20 bp, Artificial Sequence
  Synthetic construct
gtagtaggcaagtgcctcta

SEQ ID NO: 1064 - DNA, 20 bp, Artificial Sequence
  Synthetic construct
tagtaggcaagtgcctctag

SEQ ID NO: 1065 - DNA, 20 bp, Artificial Sequence
  Synthetic construct
agtaggcaagtgcctctagc

SEQ ID NO: 1066 - DNA, 20 bp, Artificial Sequence
  Synthetic construct
gtaggcaagtgcctctagca

SEQ ID NO: 1067 - DNA, 20 bp, Artificial Sequence
  Synthetic construct
taggcaagtgcctctagcac

SEQ ID NO: 1068 - DNA, 20 bp, Artificial Sequence
  Synthetic construct
aggcaagtgcctctagcaca

SEQ ID NO: 1069 - DNA, 20 bp, Artificial Sequence
  Synthetic construct
ggcaagtgcctctagcacac

SEQ ID NO: 1070 - DNA, 20 bp, Artificial Sequence
  Synthetic construct
gcaagtgcctctagcacacg

SEQ ID NO: 1071 - DNA, 20 bp, Artificial Sequence
  Synthetic construct
caagtgcctctagcacacgg

SEQ ID NO: 1072 - DNA, 20 bp, Artificial Sequence
  Synthetic construct
aagtgcctctagcacacggg

SEQ ID NO: 1073 - DNA, 20 bp, Artificial Sequence
  Synthetic construct
agtgcctctagcacacgggg

SEQ ID NO: 1074 - DNA, 20 bp, Artificial Sequence
  Synthetic construct
gtgcctctagcacacggggt

SEQ ID NO: 1075 - DNA, 20 bp, Artificial Sequence
  Synthetic construct
tgcctctagcacacggggtg

SEQ ID NO: 1076 - DNA, 20 bp, Artificial Sequence
  Synthetic construct
gcctctagcacacggggtgc

SEQ ID NO: 1077 - DNA, 20 bp, Artificial Sequence
  Synthetic construct
cctctagcacacggggtgca

SEQ ID NO: 1078 - DNA, 20 bp, Artificial Sequence
  Synthetic construct
ctctagcacacggggtgcaa

SEQ ID NO: 1079 - DNA, 20 bp, Artificial Sequence
  Synthetic construct
tctagcacacggggtgcaat

SEQ ID NO: 1080 - DNA, 20 bp, Artificial Sequence
  Synthetic construct
ctagcacacggggtgcaatc

SEQ ID NO: 1081 - DNA, 20 bp, Artificial Sequence
  Synthetic construct
tagcacacggggtgcaatct

SEQ ID NO: 1082 - DNA, 20 bp, Artificial Sequence
  Synthetic construct
agcacacggggtgcaatctc

SEQ ID NO: 1083 - DNA, 20 bp, Artificial Sequence
  Synthetic construct
gcacacggggtgcaatctca

SEQ ID NO: 1084 - DNA, 20 bp, Artificial Sequence
  Synthetic construct
cacacggggtgcaatctcac

SEQ ID NO: 1085 - DNA, 20 bp, Artificial Sequence
  Synthetic construct
acacggggtgcaatctcact

SEQ ID NO: 1086 - DNA, 20 bp, Artificial Sequence
  Synthetic construct
cacggggtgcaatctcactg

SEQ ID NO: 1087 - DNA, 20 bp, Artificial Sequence
  Synthetic construct
acggggtgcaatctcactgg

SEQ ID NO: 1088 - DNA, 20 bp, Artificial Sequence
  Synthetic construct
cggggtgcaatctcactggg

SEQ ID NO: 1089 - DNA, 20 bp, Artificial Sequence
  Synthetic construct
ggggtgcaatctcactggga

SEQ ID NO: 1090 - DNA, 20 bp, Artificial Sequence
  Synthetic construct
gggtgcaatctcactgggac

SEQ ID NO: 1091 - DNA, 20 bp, Artificial Sequence
  Synthetic construct
ggtgcaatctcactgggaca

SEQ ID NO: 1092 - DNA, 20 bp, Artificial Sequence
  Synthetic construct
gtgcaatctcactgggacat

SEQ ID NO: 1093 - DNA, 20 bp, Artificial Sequence
  Synthetic construct
tgcaatctcactgggacata

SEQ ID NO: 1094 - DNA, 20 bp, Artificial Sequence
  Synthetic construct
gcaatctcactgggacatat

SEQ ID NO: 1095 - DNA, 20 bp, Artificial Sequence
  Synthetic construct
caatctcactgggacatata

SEQ ID NO: 1096 - DNA, 20 bp, Artificial Sequence
  Synthetic construct
aatctcactgggacatataa

SEQ ID NO: 1097 - DNA, 20 bp, Artificial Sequence
  Synthetic construct
atctcactgggacatataat

SEQ ID NO: 1098 - DNA, 20 bp, Artificial Sequence
  Synthetic construct
tctcactgggacatataata

SEQ ID NO: 1099 - DNA, 20 bp, Artificial Sequence
  Synthetic construct
ctcactgggacatataatat

SEQ ID NO: 1100 - DNA, 20 bp, Artificial Sequence
  Synthetic construct
tcactgggacatataatatc

SEQ ID NO: 1101 - DNA, 20 bp, Artificial Sequence
  Synthetic construct
cactgggacatataatatcg

SEQ ID NO: 1102 - DNA, 20 bp, Artificial Sequence
  Synthetic construct
actgggacatataatatcgt

SEQ ID NO: 1103 - DNA, 20 bp, Artificial Sequence
  Synthetic construct
ctgggacatataatatcgtc

SEQ ID NO: 1104 - DNA, 20 bp, Artificial Sequence
  Synthetic construct
tgggacatataatatcgtcc

SEQ ID NO: 1105 - DNA, 20 bp, Artificial Sequence
  Synthetic construct
gggacatataatatcgtccc

SEQ ID NO: 1106 - DNA, 20 bp, Artificial Sequence
  Synthetic construct
ggacatataatatcgtcccc

SEQ ID NO: 1107 - DNA, 20 bp, Artificial Sequence
  Synthetic construct
gacatataatatcgtccccg

SEQ ID NO: 1108 - DNA, 20 bp, Artificial Sequence
  Synthetic construct
acatataatatcgtccccgt

SEQ ID NO: 1109 - DNA, 20 bp, Artificial Sequence
  Synthetic construct
catataatatcgtccccgta

SEQ ID NO: 1110 - DNA, 20 bp, Artificial Sequence
  Synthetic construct
atataatatcgtccccgtag

SEQ ID NO: 1111 - DNA, 20 bp, Artificial Sequence
  Synthetic construct
tataatatcgtccccgtaga

SEQ ID NO: 1112 - DNA, 20 bp, Artificial Sequence
  Synthetic construct
ataatatcgtccccgtagat

SEQ ID NO: 1113 - DNA, 20 bp, Artificial Sequence
  Synthetic construct
taatatcgtccccgtagatg

SEQ ID NO: 1114 - DNA, 20 bp, Artificial Sequence
  Synthetic construct
aatatcgtccccgtagatgc

SEQ ID NO: 1115 - DNA, 20 bp, Artificial Sequence
  Synthetic construct
atatcgtccccgtagatgcc

SEQ ID NO: 1116 - DNA, 20 bp, Artificial Sequence
  Synthetic construct
tatcgtccccgtagatgcct

SEQ ID NO: 1117 - DNA, 20 bp, Artificial Sequence
  Synthetic construct
atcgtccccgtagatgccta

SEQ ID NO: 1118 - DNA, 20 bp, Artificial Sequence
  Synthetic construct
tcgtccccgtagatgcctat

SEQ ID NO: 1119 - DNA, 20 bp, Artificial Sequence
  Synthetic construct
cgtccccgtagatgcctatg

SEQ ID NO: 1120 - DNA, 20 bp, Artificial Sequence
  Synthetic construct
gtccccgtagatgcctatgg

SEQ ID NO: 1121 - DNA, 20 bp, Artificial Sequence
  Synthetic construct
tccccgtagatgcctatggt

SEQ ID NO: 1122 - DNA, 20 bp, Artificial Sequence
  Synthetic construct
ccccgtagatgcctatggtt

SEQ ID NO: 1123 - DNA, 20 bp, Artificial Sequence
  Synthetic construct
cccgtagatgcctatggttc

SEQ ID NO: 1124 - DNA, 20 bp, Artificial Sequence
  Synthetic construct
ccgtagatgcctatggttcc

SEQ ID NO: 1125 - DNA, 20 bp, Artificial Sequence
  Synthetic construct
cgtagatgcctatggttccg

SEQ ID NO: 1126 - DNA, 20 bp, Artificial Sequence
  Synthetic construct
gtagatgcctatggttccgg

SEQ ID NO: 1127 - DNA, 20 bp, Artificial Sequence
  Synthetic construct
tagatgcctatggttccggc

SEQ ID NO: 1128 - DNA, 20 bp, Artificial Sequence
  Synthetic construct
agatgcctatggttccggcg

SEQ ID NO: 1129 - DNA, 20 bp, Artificial Sequence
  Synthetic construct
gatgcctatggttccggcgt

SEQ ID NO: 1130 - DNA, 20 bp, Artificial Sequence
  Synthetic construct
atgcctatggttccggcgtt

SEQ ID NO: 1131 - DNA, 20 bp, Artificial Sequence
  Synthetic construct
tgcctatggttccggcgtta

SEQ ID NO: 1132 - DNA, 20 bp, Artificial Sequence
  Synthetic construct
gcctatggttccggcgttac

SEQ ID NO: 1133 - DNA, 20 bp, Artificial Sequence
  Synthetic construct
cctatggttccggcgttacc

SEQ ID NO: 1134 - DNA, 20 bp, Artificial Sequence
  Synthetic construct
ctatggttccggcgttacca

SEQ ID NO: 1135 - DNA, 20 bp, Artificial Sequence
  Synthetic construct
tatggttccggcgttaccaa

SEQ ID NO: 1136 - DNA, 20 bp, Artificial Sequence
  Synthetic construct
atggttccggcgttaccaaa

SEQ ID NO: 1137 - DNA, 20 bp, Artificial Sequence
  Synthetic construct
tggttccggcgttaccaaaa

SEQ ID NO: 1138 - DNA, 20 bp, Artificial Sequence
  Synthetic construct
ggttccggcgttaccaaaat

SEQ ID NO: 1139 - DNA, 20 bp, Artificial Sequence
  Synthetic construct
gttccggcgttaccaaaatg

SEQ ID NO: 1140 - DNA, 20 bp, Artificial Sequence
  Synthetic construct
ttccggcgttaccaaaatgg

SEQ ID NO: 1141 - DNA, 20 bp, Artificial Sequence
  Synthetic construct
tccggcgttaccaaaatgga

SEQ ID NO: 1142 - DNA, 20 bp, Artificial Sequence
  Synthetic construct
ccggcgttaccaaaatggat

SEQ ID NO: 1143 - DNA, 20 bp, Artificial Sequence
  Synthetic construct
cggcgttaccaaaatggatt

SEQ ID NO: 1144 - DNA, 20 bp, Artificial Sequence
  Synthetic construct
ggcgttaccaaaatggattt

SEQ ID NO: 1145 - DNA, 20 bp, Artificial Sequence
  Synthetic construct
gcgttaccaaaatggatttg

SEQ ID NO: 1146 - DNA, 20 bp, Artificial Sequence
  Synthetic construct
cgttaccaaaatggatttgg

SEQ ID NO: 1147 - DNA, 20 bp, Artificial Sequence
  Synthetic construct
gttaccaaaatggatttggg

SEQ ID NO: 1148 - DNA, 20 bp, Artificial Sequence
  Synthetic construct
ttaccaaaatggatttgggt

SEQ ID NO: 1149 - DNA, 20 bp, Artificial Sequence
  Synthetic construct
taccaaaatggatttgggtc

SEQ ID NO: 1150 - DNA, 20 bp, Artificial Sequence
  Synthetic construct
accaaaatggatttgggtcg

SEQ ID NO: 1151 - DNA, 20 bp, Artificial Sequence
  Synthetic construct
ccaaaatggatttgggtcgc

SEQ ID NO: 1152 - DNA, 20 bp, Artificial Sequence
  Synthetic construct
caaaatggatttgggtcgct

SEQ ID NO: 1153 - DNA, 20 bp, Artificial Sequence
  Synthetic construct
aaaatggatttgggtcgctt

SEQ ID NO: 1154 - DNA, 20 bp, Artificial Sequence
  Synthetic construct
aaatggatttgggtcgcttt

SEQ ID NO: 1155 - DNA, 20 bp, Artificial Sequence
  Synthetic construct
aatggatttgggtcgctttg

SEQ ID NO: 1156 - DNA, 20 bp, Artificial Sequence
  Synthetic construct
atggatttgggtcgctttga

SEQ ID NO: 1157 - DNA, 20 bp, Artificial Sequence
  Synthetic construct
tggatttgggtcgctttgac

SEQ ID NO: 1158 - DNA, 20 bp, Artificial Sequence
  Synthetic construct
ggatttgggtcgctttgact

SEQ ID NO: 1159 - DNA, 20 bp, Artificial Sequence
  Synthetic construct
gatttgggtcgctttgacta

SEQ ID NO: 1160 - DNA, 20 bp, Artificial Sequence
  Synthetic construct
atttgggtcgctttgactat

SEQ ID NO: 1161 - DNA, 20 bp, Artificial Sequence
  Synthetic construct
tttgggtcgctttgactatt

SEQ ID NO: 1162 - DNA, 20 bp, Artificial Sequence
  Synthetic construct
ttgggtcgctttgactattg

SEQ ID NO: 1163 - DNA, 20 bp, Artificial Sequence
  Synthetic construct
tgggtcgctttgactattgc

SEQ ID NO: 1164 - DNA, 20 bp, Artificial Sequence
  Synthetic construct
gggtcgctttgactattgcc

SEQ ID NO: 1165 - DNA, 20 bp, Artificial Sequence
  Synthetic construct
ggtcgctttgactattgccc

SEQ ID NO: 1166 - DNA, 20 bp, Artificial Sequence
  Synthetic construct
gtcgctttgactattgccca

SEQ ID NO: 1167 - DNA, 20 bp, Artificial Sequence
  Synthetic construct
tcgctttgactattgcccag

SEQ ID NO: 1168 - DNA, 20 bp, Artificial Sequence
  Synthetic construct
cgctttgactattgcccaga

SEQ ID NO: 1169 - DNA, 20 bp, Artificial Sequence
  Synthetic construct
gctttgactattgcccagaa

SEQ ID NO: 1170 - DNA, 20 bp, Artificial Sequence
  Synthetic construct
ctttgactattgcccagaat

SEQ ID NO: 1171 - DNA, 20 bp, Artificial Sequence
  Synthetic construct
tttgactattgcccagaata

SEQ ID NO: 1172 - DNA, 20 bp, Artificial Sequence
  Synthetic construct
ttgactattgcccagaatat

SEQ ID NO: 1173 - DNA, 20 bp, Artificial Sequence
  Synthetic construct
tgactattgcccagaatatc

SEQ ID NO: 1174 - DNA, 20 bp, Artificial Sequence
  Synthetic construct
gactattgcccagaatatca

SEQ ID NO: 1175 - DNA, 20 bp, Artificial Sequence
  Synthetic construct
actattgcccagaatatcat

SEQ ID NO: 1176 - DNA, 20 bp, Artificial Sequence
  Synthetic construct
ctattgcccagaatatcatg

SEQ ID NO: 1177 - DNA, 20 bp, Artificial Sequence
  Synthetic construct
tattgcccagaatatcatgg

SEQ ID NO: 1178 - DNA, 20 bp, Artificial Sequence
  Synthetic construct
attgcccagaatatcatgga

SEQ ID NO: 1179 - DNA, 20 bp, Artificial Sequence
  Synthetic construct
ttgcccagaatatcatggac

SEQ ID NO: 1180 - DNA, 20 bp, Artificial Sequence
  Synthetic construct
tgcccagaatatcatggact

SEQ ID NO: 1181 - DNA, 20 bp, Artificial Sequence
  Synthetic construct
gcccagaatatcatggactc

SEQ ID NO: 1182 - DNA, 20 bp, Artificial Sequence
  Synthetic construct
cccagaatatcatggactct

SEQ ID NO: 1183 - DNA, 20 bp, Artificial Sequence
  Synthetic construct
ccagaatatcatggactcta

SEQ ID NO: 1184 - DNA, 20 bp, Artificial Sequence
  Synthetic construct
cagaatatcatggactctag

SEQ ID NO: 1185 - DNA, 20 bp, Artificial Sequence
  Synthetic construct
agaatatcatggactctagc

SEQ ID NO: 1186 - DNA, 20 bp, Artificial Sequence
  Synthetic construct
gaatatcatggactctagct

SEQ ID NO: 1187 - DNA, 20 bp, Artificial Sequence
  Synthetic construct
aatatcatggactctagctc

SEQ ID NO: 1188 - DNA, 20 bp, Artificial Sequence
  Synthetic construct
atatcatggactctagctca

SEQ ID NO: 1189 - DNA, 20 bp, Artificial Sequence
  Synthetic construct
tatcatggactctagctcaa

SEQ ID NO: 1190 - DNA, 20 bp, Artificial Sequence
  Synthetic construct
atcatggactctagctcaaa

SEQ ID NO: 1191 - DNA, 20 bp, Artificial Sequence
  Synthetic construct
tcatggactctagctcaaat

SEQ ID NO: 1192 - DNA, 20 bp, Artificial Sequence
  Synthetic construct
catggactctagctcaaatg

SEQ ID NO: 1193 - DNA, 20 bp, Artificial Sequence
  Synthetic construct
atggactctagctcaaatgt

SEQ ID NO: 1194 - DNA, 20 bp, Artificial Sequence
  Synthetic construct
tggactctagctcaaatgtg

SEQ ID NO: 1195 - DNA, 20 bp, Artificial Sequence
  Synthetic construct
ggactctagctcaaatgtga

SEQ ID NO: 1196 - DNA, 20 bp, Artificial Sequence
  Synthetic construct
gactctagctcaaatgtgaa

SEQ ID NO: 1197 - DNA, 20 bp, Artificial Sequence
  Synthetic construct
actctagctcaaatgtgaac

SEQ ID NO: 1198 - DNA, 20 bp, Artificial Sequence
  Synthetic construct
ctctagctcaaatgtgaacc

SEQ ID NO: 1199 - DNA, 20 bp, Artificial Sequence
  Synthetic construct
tctagctcaaatgtgaaccc

SEQ ID NO: 1200 - DNA, 20 bp, Artificial Sequence
  Synthetic construct
ctagctcaaatgtgaaccca

SEQ ID NO: 1201 - DNA, 20 bp, Artificial Sequence
  Synthetic construct
tagctcaaatgtgaacccat

SEQ ID NO: 1202 - DNA, 20 bp, Artificial Sequence
  Synthetic construct
agctcaaatgtgaacccatt

SEQ ID NO: 1203 - DNA, 20 bp, Artificial Sequence
  Synthetic construct
gctcaaatgtgaacccattt

SEQ ID NO: 1204 - DNA, 20 bp, Artificial Sequence
  Synthetic construct
ctcaaatgtgaacccatttc

SEQ ID NO: 1205 - DNA, 20 bp, Artificial Sequence
  Synthetic construct
tcaaatgtgaacccatttcc

SEQ ID NO: 1206 - DNA, 20 bp, Artificial Sequence
  Synthetic construct
caaatgtgaacccatttccc

SEQ ID NO: 1207 - DNA, 20 bp, Artificial Sequence
  Synthetic construct
aaatgtgaacccatttccca

SEQ ID NO: 1208 - DNA, 20 bp, Artificial Sequence
  Synthetic construct
aatgtgaacccatttcccat

SEQ ID NO: 1209 - DNA, 20 bp, Artificial Sequence
  Synthetic construct
atgtgaacccatttcccatt

SEQ ID NO: 1210 - DNA, 20 bp, Artificial Sequence
  Synthetic construct
tgtgaacccatttcccattg

SEQ ID NO: 1211 - DNA, 20 bp, Artificial Sequence
  Synthetic construct
gtgaacccatttcccattgt

SEQ ID NO: 1212 - DNA, 20 bp, Artificial Sequence
  Synthetic construct
tgaacccatttcccattgtg

SEQ ID NO: 1213 - DNA, 20 bp, Artificial Sequence
  Synthetic construct
gaacccatttcccattgtgg

SEQ ID NO: 1214 - DNA, 20 bp, Artificial Sequence
  Synthetic construct
aacccatttcccattgtgga

SEQ ID NO: 1215 - DNA, 20 bp, Artificial Sequence
  Synthetic construct
acccatttcccattgtggaa

SEQ ID NO: 1216 - DNA, 20 bp, Artificial Sequence
  Synthetic construct
cccatttcccattgtggaaa

SEQ ID NO: 1217 - DNA, 20 bp, Artificial Sequence
  Synthetic construct
ccatttcccattgtggaaaa

SEQ ID NO: 1218 - DNA, 20 bp, Artificial Sequence
  Synthetic construct
catttcccattgtggaaaat

SEQ ID NO: 1219 - DNA, 20 bp, Artificial Sequence
  Synthetic construct
atttcccattgtggaaaata

SEQ ID NO: 1220 - DNA, 20 bp, Artificial Sequence
  Synthetic construct
tttcccattgtggaaaatag

SEQ ID NO: 1221 - DNA, 20 bp, Artificial Sequence
  Synthetic construct
ttcccattgtggaaaatagt

SEQ ID NO: 1222 - DNA, 20 bp, Artificial Sequence
  Synthetic construct
tcccattgtggaaaatagtt

SEQ ID NO: 1223 - DNA, 20 bp, Artificial Sequence
  Synthetic construct
cccattgtggaaaatagttc

SEQ ID NO: 1224 - DNA, 20 bp, Artificial Sequence
  Synthetic construct
ccattgtggaaaatagttcc

SEQ ID NO: 1225 - DNA, 20 bp, Artificial Sequence
  Synthetic construct
cattgtggaaaatagttccc

SEQ ID NO: 1226 - DNA, 20 bp, Artificial Sequence
  Synthetic construct
attgtggaaaatagttccca

SEQ ID NO: 1227 - DNA, 20 bp, Artificial Sequence
  Synthetic construct
ttgtggaaaatagttcccat

SEQ ID NO: 1228 - DNA, 20 bp, Artificial Sequence
  Synthetic construct
tgtggaaaatagttcccatc

SEQ ID NO: 1229 - DNA, 20 bp, Artificial Sequence
  Synthetic construct
gtggaaaatagttcccatcg

SEQ ID NO: 1230 - DNA, 20 bp, Artificial Sequence
  Synthetic construct
tggaaaatagttcccatcgt

SEQ ID NO: 1231 - DNA, 20 bp, Artificial Sequence
  Synthetic construct
ggaaaatagttcccatcgta

SEQ ID NO: 1232 - DNA, 20 bp, Artificial Sequence
  Synthetic construct
gaaaatagttcccatcgtat

SEQ ID NO: 1233 - DNA, 20 bp, Artificial Sequence
  Synthetic construct
aaaatagttcccatcgtatc

SEQ ID NO: 1234 - DNA, 20 bp, Artificial Sequence
  Synthetic construct
aaatagttcccatcgtatcg

SEQ ID NO: 1235 - DNA, 20 bp, Artificial Sequence
  Synthetic construct
aatagttcccatcgtatcgt

SEQ ID NO: 1236 - DNA, 20 bp, Artificial Sequence
  Synthetic construct
atagttcccatcgtatcgtc

SEQ ID NO: 1237 - DNA, 20 bp, Artificial Sequence
  Synthetic construct
tagttcccatcgtatcgtct

SEQ ID NO: 1238 - DNA, 20 bp, Artificial Sequence
  Synthetic construct
agttcccatcgtatcgtctc

SEQ ID NO: 1239 - DNA, 20 bp, Artificial Sequence
  Synthetic construct
gttcccatcgtatcgtctcg

SEQ ID NO: 1240 - DNA, 20 bp, Artificial Sequence
  Synthetic construct
ttcccatcgtatcgtctcgc

SEQ ID NO: 1241 - DNA, 20 bp, Artificial Sequence
  Synthetic construct
tcccatcgtatcgtctcgcc

SEQ ID NO: 1242 - DNA, 20 bp, Artificial Sequence
  Synthetic construct
cccatcgtatcgtctcgcca

SEQ ID NO: 1243 - DNA, 20 bp, Artificial Sequence
  Synthetic construct
ccatcgtatcgtctcgccat

SEQ ID NO: 1244 - DNA, 20 bp, Artificial Sequence
  Synthetic construct
catcgtatcgtctcgccatc

SEQ ID NO: 1245 - DNA, 20 bp, Artificial Sequence
  Synthetic construct
atcgtatcgtctcgccatct

SEQ ID NO: 1246 - DNA, 20 bp, Artificial Sequence
  Synthetic construct
tcgtatcgtctcgccatcta

SEQ ID NO: 1247 - DNA, 20 bp, Artificial Sequence
  Synthetic construct
cgtatcgtctcgccatctac

SEQ ID NO: 1248 - DNA, 20 bp, Artificial Sequence
  Synthetic construct
gtatcgtctcgccatctacg

SEQ ID NO: 1249 - DNA, 20 bp, Artificial Sequence
  Synthetic construct
tatcgtctcgccatctacga

SEQ ID NO: 1250 - DNA, 20 bp, Artificial Sequence
  Synthetic construct
atcgtctcgccatctacgat

SEQ ID NO: 1251 - DNA, 20 bp, Artificial Sequence
  Synthetic construct
tcgtctcgccatctacgatt

SEQ ID NO: 1252 - DNA, 20 bp, Artificial Sequence
  Synthetic construct
cgtctcgccatctacgattc

SEQ ID NO: 1253 - DNA, 20 bp, Artificial Sequence
  Synthetic construct
gtctcgccatctacgattcc

SEQ ID NO: 1254 - DNA, 20 bp, Artificial Sequence
  Synthetic construct
tctcgccatctacgattccg

SEQ ID NO: 1255 - DNA, 20 bp, Artificial Sequence
  Synthetic construct
ctcgccatctacgattccgt

SEQ ID NO: 1256 - DNA, 20 bp, Artificial Sequence
  Synthetic construct
tcgccatctacgattccgta

SEQ ID NO: 1257 - DNA, 20 bp, Artificial Sequence
  Synthetic construct
cgccatctacgattccgtag

SEQ ID NO: 1258 - DNA, 20 bp, Artificial Sequence
  Synthetic construct
gccatctacgattccgtagt

SEQ ID NO: 1259 - DNA, 20 bp, Artificial Sequence
  Synthetic construct
ccatctacgattccgtagtg

SEQ ID NO: 1260 - DNA, 20 bp, Artificial Sequence
  Synthetic construct
catctacgattccgtagtgt

SEQ ID NO: 1261 - DNA, 20 bp, Artificial Sequence
  Synthetic construct
atctacgattccgtagtgtg

SEQ ID NO: 1262 - DNA, 20 bp, Artificial Sequence
  Synthetic construct
tctacgattccgtagtgtga

SEQ ID NO: 1263 - DNA, 20 bp, Artificial Sequence
  Synthetic construct
ctacgattccgtagtgtgag

SEQ ID NO: 1264 - DNA, 20 bp, Artificial Sequence
  Synthetic construct
tacgattccgtagtgtgagc

SEQ ID NO: 1265 - DNA, 20 bp, Artificial Sequence
  Synthetic construct
acgattccgtagtgtgagcg

SEQ ID NO: 1266 - DNA, 20 bp, Artificial Sequence
  Synthetic construct
cgattccgtagtgtgagcgg

SEQ ID NO: 1267 - DNA, 20 bp, Artificial Sequence
  Synthetic construct
gattccgtagtgtgagcgga

SEQ ID NO: 1268 - DNA, 20 bp, Artificial Sequence
  Synthetic construct
attccgtagtgtgagcggat

SEQ ID NO: 1269 - DNA, 20 bp, Artificial Sequence
  Synthetic construct
ttccgtagtgtgagcggata

SEQ ID NO: 1270 - DNA, 20 bp, Artificial Sequence
  Synthetic construct
tccgtagtgtgagcggatac

SEQ ID NO: 1271 - DNA, 20 bp, Artificial Sequence
  Synthetic construct
ccgtagtgtgagcggatacg

SEQ ID NO: 1272 - DNA, 20 bp, Artificial Sequence
  Synthetic construct
cgtagtgtgagcggatacga

SEQ ID NO: 1273 - DNA, 20 bp, Artificial Sequence
  Synthetic construct
gtagtgtgagcggatacgat

SEQ ID NO: 1274 - DNA, 20 bp, Artificial Sequence
  Synthetic construct
tagtgtgagcggatacgatc

SEQ ID NO: 1275 - DNA, 20 bp, Artificial Sequence
  Synthetic construct
agtgtgagcggatacgatcg

SEQ ID NO: 1276 - DNA, 20 bp, Artificial Sequence
  Synthetic construct
gtgtgagcggatacgatcga

SEQ ID NO: 1277 - DNA, 20 bp, Artificial Sequence
  Synthetic construct
tgtgagcggatacgatcgag

SEQ ID NO: 1278 - DNA, 20 bp, Artificial Sequence
  Synthetic construct
gtgagcggatacgatcgaga

SEQ ID NO: 1279 - DNA, 20 bp, Artificial Sequence
  Synthetic construct
tgagcggatacgatcgagat

SEQ ID NO: 1280 - DNA, 20 bp, Artificial Sequence
  Synthetic construct
gagcggatacgatcgagata

SEQ ID NO: 1281 - DNA, 20 bp, Artificial Sequence
  Synthetic construct
agcggatacgatcgagatat

SEQ ID NO: 1282 - DNA, 20 bp, Artificial Sequence
  Synthetic construct
gcggatacgatcgagatatg

SEQ ID NO: 1283 - DNA, 20 bp, Artificial Sequence
  Synthetic construct
cggatacgatcgagatatga

SEQ ID NO: 1284 - DNA, 20 bp, Artificial Sequence
  Synthetic construct
ggatacgatcgagatatgaa

SEQ ID NO: 1285 - DNA, 20 bp, Artificial Sequence
  Synthetic construct
gatacgatcgagatatgaat

SEQ ID NO: 1286 - DNA, 20 bp, Artificial Sequence
  Synthetic construct
atacgatcgagatatgaata

SEQ ID NO: 1287 - DNA, 20 bp, Artificial Sequence
  Synthetic construct
tacgatcgagatatgaatat

SEQ ID NO: 1288 - DNA, 20 bp, Artificial Sequence
  Synthetic construct
acgatcgagatatgaatata

SEQ ID NO: 1289 - DNA, 20 bp, Artificial Sequence
  Synthetic construct
cgatcgagatatgaatatag

SEQ ID NO: 1290 - DNA, 20 bp, Artificial Sequence
  Synthetic construct
gatcgagatatgaatatagc

SEQ ID NO: 1291 - DNA, 20 bp, Artificial Sequence
  Synthetic construct
atcgagatatgaatatagct

SEQ ID NO: 1292 - DNA, 20 bp, Artificial Sequence
  Synthetic construct
tcgagatatgaatatagctc

SEQ ID NO: 1293 - DNA, 20 bp, Artificial Sequence
  Synthetic construct
cgagatatgaatatagctct

SEQ ID NO: 1294 - DNA, 20 bp, Artificial Sequence
  Synthetic construct
gagatatgaatatagctctg

SEQ ID NO: 1295 - DNA, 20 bp, Artificial Sequence
  Synthetic construct
agatatgaatatagctctgg

SEQ ID NO: 1296 - DNA, 20 bp, Artificial Sequence
  Synthetic construct
gatatgaatatagctctggt

SEQ ID NO: 1297 - DNA, 20 bp, Artificial Sequence
  Synthetic construct
atatgaatatagctctggtg

SEQ ID NO: 1298 - DNA, 20 bp, Artificial Sequence
  Synthetic construct
tatgaatatagctctggtgg

SEQ ID NO: 1299 - DNA, 20 bp, Artificial Sequence
  Synthetic construct
atgaatatagctctggtggg

SEQ ID NO: 1300 - DNA, 20 bp, Artificial Sequence
  Synthetic construct
tgaatatagctctggtggga

SEQ ID NO: 1301 - DNA, 20 bp, Artificial Sequence
  Synthetic construct
gaatatagctctggtgggag

SEQ ID NO: 1302 - DNA, 20 bp, Artificial Sequence
  Synthetic construct
aatatagctctggtgggaga

SEQ ID NO: 1303 - DNA, 20 bp, Artificial Sequence
  Synthetic construct
atatagctctggtgggagaa

SEQ ID NO: 1304 - DNA, 20 bp, Artificial Sequence
  Synthetic construct
tatagctctggtgggagaaa

SEQ ID NO: 1305 - DNA, 20 bp, Artificial Sequence
  Synthetic construct
atagctctggtgggagaaaa

SEQ ID NO: 1306 - DNA, 20 bp, Artificial Sequence
  Synthetic construct
tagctctggtgggagaaaac

SEQ ID NO: 1307 - DNA, 20 bp, Artificial Sequence
  Synthetic construct
agctctggtgggagaaaact

SEQ ID NO: 1308 - DNA, 20 bp, Artificial Sequence
  Synthetic construct
gctctggtgggagaaaactc

SEQ ID NO: 1309 - DNA, 20 bp, Artificial Sequence
  Synthetic construct
ctctggtgggagaaaactcc

SEQ ID NO: 1310 - DNA, 20 bp, Artificial Sequence
  Synthetic construct
tctggtgggagaaaactcca

SEQ ID NO: 1311 - DNA, 20 bp, Artificial Sequence
  Synthetic construct
ctggtgggagaaaactccac

SEQ ID NO: 1312 - DNA, 20 bp, Artificial Sequence
  Synthetic construct
tggtgggagaaaactccaca

SEQ ID NO: 1313 - DNA, 20 bp, Artificial Sequence
  Synthetic construct
ggtgggagaaaactccacac

SEQ ID NO: 1314 - DNA, 20 bp, Artificial Sequence
  Synthetic construct
gtgggagaaaactccacacc

SEQ ID NO: 1315 - DNA, 20 bp, Artificial Sequence
  Synthetic construct
tgggagaaaactccacacca

SEQ ID NO: 1316 - DNA, 20 bp, Artificial Sequence
  Synthetic construct
gggagaaaactccacaccag

SEQ ID NO: 1317 - DNA, 20 bp, Artificial Sequence
  Synthetic construct
ggagaaaactccacaccagg

SEQ ID NO: 1318 - DNA, 20 bp, Artificial Sequence
  Synthetic construct
gagaaaactccacaccaggc

SEQ ID NO: 1319 - DNA, 20 bp, Artificial Sequence
  Synthetic construct
agaaaactccacaccaggcg

SEQ ID NO: 1320 - DNA, 20 bp, Artificial Sequence
  Synthetic construct
gaaaactccacaccaggcga

SEQ ID NO: 1321 - DNA, 20 bp, Artificial Sequence
  Synthetic construct
aaaactccacaccaggcgat

SEQ ID NO: 1322 - DNA, 20 bp, Artificial Sequence
  Synthetic construct
aaactccacaccaggcgatc

SEQ ID NO: 1323 - DNA, 20 bp, Artificial Sequence
  Synthetic construct
aactccacaccaggcgatcg

SEQ ID NO: 1324 - DNA, 20 bp, Artificial Sequence
  Synthetic construct
actccacaccaggcgatcgg

SEQ ID NO: 1325 - DNA, 20 bp, Artificial Sequence
  Synthetic construct
ctccacaccaggcgatcgga

SEQ ID NO: 1326 - DNA, 20 bp, Artificial Sequence
  Synthetic construct
tccacaccaggcgatcggag

SEQ ID NO: 1327 - DNA, 20 bp, Artificial Sequence
  Synthetic construct
ccacaccaggcgatcggaga

SEQ ID NO: 1328 - DNA, 20 bp, Artificial Sequence
  Synthetic construct
cacaccaggcgatcggagat

SEQ ID NO: 1329 - DNA, 20 bp, Artificial Sequence
  Synthetic construct
acaccaggcgatcggagatg

SEQ ID NO: 1330 - DNA, 20 bp, Artificial Sequence
  Synthetic construct
caccaggcgatcggagatgg

SEQ ID NO: 1331 - DNA, 20 bp, Artificial Sequence
  Synthetic construct
accaggcgatcggagatgga

SEQ ID NO: 1332 - DNA, 20 bp, Artificial Sequence
  Synthetic construct
ccaggcgatcggagatggaa

SEQ ID NO: 1333 - DNA, 20 bp, Artificial Sequence
  Synthetic construct
caggcgatcggagatggaat

SEQ ID NO: 1334 - DNA, 20 bp, Artificial Sequence
  Synthetic construct
aggcgatcggagatggaatc

SEQ ID NO: 1335 - DNA, 20 bp, Artificial Sequence
  Synthetic construct
ggcgatcggagatggaatcg

SEQ ID NO: 1336 - DNA, 20 bp, Artificial Sequence
  Synthetic construct
gcgatcggagatggaatcgg

SEQ ID NO: 1337 - DNA, 20 bp, Artificial Sequence
  Synthetic construct
cgatcggagatggaatcgga

SEQ ID NO: 1338 - DNA, 20 bp, Artificial Sequence
  Synthetic construct
gatcggagatggaatcggat

SEQ ID NO: 1339 - DNA, 20 bp, Artificial Sequence
  Synthetic construct
atcggagatggaatcggatg

SEQ ID NO: 1340 - DNA, 20 bp, Artificial Sequence
  Synthetic construct
tcggagatggaatcggatgc

SEQ ID NO: 1341 - DNA, 20 bp, Artificial Sequence
  Synthetic construct
cggagatggaatcggatgca

SEQ ID NO: 1342 - DNA, 20 bp, Artificial Sequence
  Synthetic construct
ggagatggaatcggatgcag

SEQ ID NO: 1343 - DNA, 20 bp, Artificial Sequence
  Synthetic construct
gagatggaatcggatgcaga

SEQ ID NO: 1344 - DNA, 20 bp, Artificial Sequence
  Synthetic construct
agatggaatcggatgcagac

SEQ ID NO: 1345 - DNA, 20 bp, Artificial Sequence
  Synthetic construct
gatggaatcggatgcagacg

SEQ ID NO: 1346 - DNA, 20 bp, Artificial Sequence
  Synthetic construct
atggaatcggatgcagacga

SEQ ID NO: 1347 - DNA, 20 bp, Artificial Sequence
  Synthetic construct
tggaatcggatgcagacgat

SEQ ID NO: 1348 - DNA, 20 bp, Artificial Sequence
  Synthetic construct
ggaatcggatgcagacgata

SEQ ID NO: 1349 - DNA, 20 bp, Artificial Sequence
  Synthetic construct
gaatcggatgcagacgataa

SEQ ID NO: 1350 - DNA, 20 bp, Artificial Sequence
  Synthetic construct
aatcggatgcagacgataag

SEQ ID NO: 1351 - DNA, 20 bp, Artificial Sequence
  Synthetic construct
atcggatgcagacgataagt

SEQ ID NO: 1352 - DNA, 20 bp, Artificial Sequence
  Synthetic construct
tcggatgcagacgataagtc

SEQ ID NO: 1353 - DNA, 20 bp, Artificial Sequence
  Synthetic construct
cggatgcagacgataagtct

SEQ ID NO: 1354 - DNA, 20 bp, Artificial Sequence
  Synthetic construct
ggatgcagacgataagtcta

SEQ ID NO: 1355 - DNA, 20 bp, Artificial Sequence
  Synthetic construct
gatgcagacgataagtctat

SEQ ID NO: 1356 - DNA, 20 bp, Artificial Sequence
  Synthetic construct
atgcagacgataagtctatc

SEQ ID NO: 1357 - DNA, 20 bp, Artificial Sequence
  Synthetic construct
tgcagacgataagtctatcg

SEQ ID NO: 1358 - DNA, 20 bp, Artificial Sequence
  Synthetic construct
gcagacgataagtctatcgt

SEQ ID NO: 1359 - DNA, 20 bp, Artificial Sequence
  Synthetic construct
cagacgataagtctatcgtc

SEQ ID NO: 1360 - DNA, 20 bp, Artificial Sequence
  Synthetic construct
agacgataagtctatcgtcg

SEQ ID NO: 1361 - DNA, 20 bp, Artificial Sequence
  Synthetic construct
gacgataagtctatcgtcgc

SEQ ID NO: 1362 - DNA, 20 bp, Artificial Sequence
  Synthetic construct
acgataagtctatcgtcgca

SEQ ID NO: 1363 - DNA, 20 bp, Artificial Sequence
  Synthetic construct
cgataagtctatcgtcgcaa

SEQ ID NO: 1364 - DNA, 20 bp, Artificial Sequence
  Synthetic construct
gataagtctatcgtcgcaag

SEQ ID NO: 1365 - DNA, 20 bp, Artificial Sequence
  Synthetic construct
ataagtctatcgtcgcaagc

SEQ ID NO: 1366 - DNA, 20 bp, Artificial Sequence
  Synthetic construct
taagtctatcgtcgcaagcg

SEQ ID NO: 1367 - DNA, 20 bp, Artificial Sequence
  Synthetic construct
aagtctatcgtcgcaagcga

SEQ ID NO: 1368 - DNA, 20 bp, Artificial Sequence
  Synthetic construct
agtctatcgtcgcaagcgaa

SEQ ID NO: 1369 - DNA, 20 bp, Artificial Sequence
  Synthetic construct
gtctatcgtcgcaagcgaac

SEQ ID NO: 1370 - DNA, 20 bp, Artificial Sequence
  Synthetic construct
tctatcgtcgcaagcgaacc

SEQ ID NO: 1371 - DNA, 20 bp, Artificial Sequence
  Synthetic construct
ctatcgtcgcaagcgaacca

SEQ ID NO: 1372 - DNA, 20 bp, Artificial Sequence
  Synthetic construct
tatcgtcgcaagcgaaccat

SEQ ID NO: 1373 - DNA, 20 bp, Artificial Sequence
  Synthetic construct
atcgtcgcaagcgaaccatc

SEQ ID NO: 1374 - DNA, 20 bp, Artificial Sequence
  Synthetic construct
tcgtcgcaagcgaaccatct

SEQ ID NO: 1375 - DNA, 20 bp, Artificial Sequence
  Synthetic construct
cgtcgcaagcgaaccatcta

SEQ ID NO: 1376 - DNA, 20 bp, Artificial Sequence
  Synthetic construct
gtcgcaagcgaaccatctac

SEQ ID NO: 1377 - DNA, 20 bp, Artificial Sequence
  Synthetic construct
tcgcaagcgaaccatctacg

SEQ ID NO: 1378 - DNA, 20 bp, Artificial Sequence
  Synthetic construct
cgcaagcgaaccatctacgc

SEQ ID NO: 1379 - DNA, 20 bp, Artificial Sequence
  Synthetic construct
gcaagcgaaccatctacgct

SEQ ID NO: 1380 - DNA, 20 bp, Artificial Sequence
  Synthetic construct
caagcgaaccatctacgctg

SEQ ID NO: 1381 - DNA, 20 bp, Artificial Sequence
  Synthetic construct
aagcgaaccatctacgctgc

SEQ ID NO: 1382 - DNA, 20 bp, Artificial Sequence
  Synthetic construct
agcgaaccatctacgctgcc

SEQ ID NO: 1383 - DNA, 20 bp, Artificial Sequence
  Synthetic construct
gcgaaccatctacgctgccc

SEQ ID NO: 1384 - DNA, 20 bp, Artificial Sequence
  Synthetic construct
cgaaccatctacgctgccct

SEQ ID NO: 1385 - DNA, 20 bp, Artificial Sequence
  Synthetic construct
gaaccatctacgctgccctg

SEQ ID NO: 1386 - DNA, 20 bp, Artificial Sequence
  Synthetic construct
aaccatctacgctgccctgc

SEQ ID NO: 1387 - DNA, 20 bp, Artificial Sequence
  Synthetic construct
accatctacgctgccctgct

SEQ ID NO: 1388 - DNA, 20 bp, Artificial Sequence
  Synthetic construct
ccatctacgctgccctgctg

SEQ ID NO: 1389 - DNA, 20 bp, Artificial Sequence
  Synthetic construct
catctacgctgccctgctga

SEQ ID NO: 1390 - DNA, 20 bp, Artificial Sequence
  Synthetic construct
atctacgctgccctgctgag

SEQ ID NO: 1391 - DNA, 20 bp, Artificial Sequence
  Synthetic construct
tctacgctgccctgctgagc

SEQ ID NO: 1392 - DNA, 20 bp, Artificial Sequence
  Synthetic construct
ctacgctgccctgctgagcc

SEQ ID NO: 1393 - DNA, 20 bp, Artificial Sequence
  Synthetic construct
tacgctgccctgctgagcca

SEQ ID NO: 1394 - DNA, 20 bp, Artificial Sequence
  Synthetic construct
acgctgccctgctgagccag

SEQ ID NO: 1395 - DNA, 20 bp, Artificial Sequence
  Synthetic construct
cgctgccctgctgagccaga

SEQ ID NO: 1396 - DNA, 20 bp, Artificial Sequence
  Synthetic construct
gctgccctgctgagccagac

SEQ ID NO: 1397 - DNA, 20 bp, Artificial Sequence
  Synthetic construct
ctgccctgctgagccagacg

SEQ ID NO: 1398 - DNA, 20 bp, Artificial Sequence
  Synthetic construct
tgccctgctgagccagacgc

SEQ ID NO: 1399 - DNA, 20 bp, Artificial Sequence
  Synthetic construct
gccctgctgagccagacgct

SEQ ID NO: 1400 - DNA, 20 bp, Artificial Sequence
  Synthetic construct
ccctgctgagccagacgctg

SEQ ID NO: 1401 - DNA, 20 bp, Artificial Sequence
  Synthetic construct
cctgctgagccagacgctgg

SEQ ID NO: 1402 - DNA, 20 bp, Artificial Sequence
  Synthetic construct
ctgctgagccagacgctggt

SEQ ID NO: 1403 - DNA, 20 bp, Artificial Sequence
  Synthetic construct
tgctgagccagacgctggtt

SEQ ID NO: 1404 - DNA, 20 bp, Artificial Sequence
  Synthetic construct
gctgagccagacgctggttg

SEQ ID NO: 1405 - DNA, 20 bp, Artificial Sequence
  Synthetic construct
ctgagccagacgctggttga

SEQ ID NO: 1406 - DNA, 20 bp, Artificial Sequence
  Synthetic construct
tgagccagacgctggttgat

SEQ ID NO: 1407 - DNA, 20 bp, Artificial Sequence
  Synthetic construct
gagccagacgctggttgatc

SEQ ID NO: 1408 - DNA, 20 bp, Artificial Sequence
  Synthetic construct
agccagacgctggttgatcg

SEQ ID NO: 1409 - DNA, 20 bp, Artificial Sequence
  Synthetic construct
gccagacgctggttgatcga

SEQ ID NO: 1410 - DNA, 20 bp, Artificial Sequence
  Synthetic construct
ccagacgctggttgatcgat

SEQ ID NO: 1411 - DNA, 20 bp, Artificial Sequence
  Synthetic construct
cagacgctggttgatcgatt

SEQ ID NO: 1412 - DNA, 20 bp, Artificial Sequence
  Synthetic construct
agacgctggttgatcgattg

SEQ ID NO: 1413 - DNA, 20 bp, Artificial Sequence
  Synthetic construct
gacgctggttgatcgattga

SEQ ID NO: 1414 - DNA, 20 bp, Artificial Sequence
  Synthetic construct
acgctggttgatcgattgat

SEQ ID NO: 1415 - DNA, 20 bp, Artificial Sequence
  Synthetic construct
cgctggttgatcgattgatc

SEQ ID NO: 1416 - DNA, 20 bp, Artificial Sequence
  Synthetic construct
gctggttgatcgattgatca

SEQ ID NO: 1417 - DNA, 20 bp, Artificial Sequence
  Synthetic construct
ctggttgatcgattgatcat

SEQ ID NO: 1418 - DNA, 20 bp, Artificial Sequence
  Synthetic construct
tggttgatcgattgatcatt

SEQ ID NO: 1419 - DNA, 20 bp, Artificial Sequence
  Synthetic construct
ggttgatcgattgatcattc

SEQ ID NO: 1420 - DNA, 20 bp, Artificial Sequence
  Synthetic construct
gttgatcgattgatcattca

SEQ ID NO: 1421 - DNA, 20 bp, Artificial Sequence
  Synthetic construct
ttgatcgattgatcattcag

SEQ ID NO: 1422 - DNA, 20 bp, Artificial Sequence
  Synthetic construct
tgatcgattgatcattcagg

SEQ ID NO: 1423 - DNA, 20 bp, Artificial Sequence
  Synthetic construct
gatcgattgatcattcaggt

SEQ ID NO: 1424 - DNA, 20 bp, Artificial Sequence
  Synthetic construct
atcgattgatcattcaggtc

SEQ ID NO: 1425 - DNA, 20 bp, Artificial Sequence
  Synthetic construct
tcgattgatcattcaggtct

SEQ ID NO: 1426 - DNA, 20 bp, Artificial Sequence
  Synthetic construct
cgattgatcattcaggtcta

SEQ ID NO: 1427 - DNA, 20 bp, Artificial Sequence
  Synthetic construct
gattgatcattcaggtctat

SEQ ID NO: 1428 - DNA, 20 bp, Artificial Sequence
  Synthetic construct
attgatcattcaggtctata

SEQ ID NO: 1429 - DNA, 20 bp, Artificial Sequence
  Synthetic construct
ttgatcattcaggtctatac

SEQ ID NO: 1430 - DNA, 20 bp, Artificial Sequence
  Synthetic construct
tgatcattcaggtctatacc

SEQ ID NO: 1431 - DNA, 20 bp, Artificial Sequence
  Synthetic construct
gatcattcaggtctatacca

SEQ ID NO: 1432 - DNA, 20 bp, Artificial Sequence
  Synthetic construct
atcattcaggtctataccaa

SEQ ID NO: 1433 - DNA, 20 bp, Artificial Sequence
  Synthetic construct
tcattcaggtctataccaac

SEQ ID NO: 1434 - DNA, 20 bp, Artificial Sequence
  Synthetic construct
cattcaggtctataccaacg

SEQ ID NO: 1435 - DNA, 20 bp, Artificial Sequence
  Synthetic construct
attcaggtctataccaacgg

SEQ ID NO: 1436 - DNA, 20 bp, Artificial Sequence
  Synthetic construct
ttcaggtctataccaacgga

SEQ ID NO: 1437 - DNA, 20 bp, Artificial Sequence
  Synthetic construct
tcaggtctataccaacggat

SEQ ID NO: 1438 - DNA, 20 bp, Artificial Sequence
  Synthetic construct
caggtctataccaacggatt

SEQ ID NO: 1439 - DNA, 20 bp, Artificial Sequence
  Synthetic construct
aggtctataccaacggattt

SEQ ID NO: 1440 - DNA, 20 bp, Artificial Sequence
  Synthetic construct
ggtctataccaacggatttg

SEQ ID NO: 1441 - DNA, 20 bp, Artificial Sequence
  Synthetic construct
gtctataccaacggatttga

SEQ ID NO: 1442 - DNA, 20 bp, Artificial Sequence
  Synthetic construct
tctataccaacggatttgag

SEQ ID NO: 1443 - DNA, 20 bp, Artificial Sequence
  Synthetic construct
ctataccaacggatttgagc

SEQ ID NO: 1444 - DNA, 20 bp, Artificial Sequence
  Synthetic construct
tataccaacggatttgagcc

SEQ ID NO: 1445 - DNA, 20 bp, Artificial Sequence
  Synthetic construct
ataccaacggatttgagccg

SEQ ID NO: 1446 - DNA, 20 bp, Artificial Sequence
  Synthetic construct
taccaacggatttgagccgg

SEQ ID NO: 1447 - DNA, 20 bp, Artificial Sequence
  Synthetic construct
accaacggatttgagccggc

SEQ ID NO: 1448 - DNA, 20 bp, Artificial Sequence
  Synthetic construct
ccaacggatttgagccggcg

SEQ ID NO: 1449 - DNA, 20 bp, Artificial Sequence
  Synthetic construct
caacggatttgagccggcgt

SEQ ID NO: 1450 - DNA, 20 bp, Artificial Sequence
  Synthetic construct
aacggatttgagccggcgtc

SEQ ID NO: 1451 - DNA, 20 bp, Artificial Sequence
  Synthetic construct
acggatttgagccggcgtct

SEQ ID NO: 1452 - DNA, 20 bp, Artificial Sequence
  Synthetic construct
cggatttgagccggcgtctg

SEQ ID NO: 1453 - DNA, 20 bp, Artificial Sequence
  Synthetic construct
ggatttgagccggcgtctga

SEQ ID NO: 1454 - DNA, 20 bp, Artificial Sequence
  Synthetic construct
gatttgagccggcgtctgat

SEQ ID NO: 1455 - DNA, 20 bp, Artificial Sequence
  Synthetic construct
atttgagccggcgtctgatg

SEQ ID NO: 1456 - DNA, 20 bp, Artificial Sequence
  Synthetic construct
tttgagccggcgtctgatga

SEQ ID NO: 1457 - DNA, 20 bp, Artificial Sequence
  Synthetic construct
ttgagccggcgtctgatgaa

SEQ ID NO: 1458 - DNA, 20 bp, Artificial Sequence
  Synthetic construct
tgagccggcgtctgatgaaa

SEQ ID NO: 1459 - DNA, 20 bp, Artificial Sequence
  Synthetic construct
gagccggcgtctgatgaaag

SEQ ID NO: 1460 - DNA, 20 bp, Artificial Sequence
  Synthetic construct
agccggcgtctgatgaaagc

SEQ ID NO: 1461 - DNA, 20 bp, Artificial Sequence
  Synthetic construct
gccggcgtctgatgaaagca

SEQ ID NO: 1462 - DNA, 20 bp, Artificial Sequence
  Synthetic construct
ccggcgtctgatgaaagcac

SEQ ID NO: 1463 - DNA, 20 bp, Artificial Sequence
  Synthetic construct
cggcgtctgatgaaagcacc

SEQ ID NO: 1464 - DNA, 20 bp, Artificial Sequence
  Synthetic construct
ggcgtctgatgaaagcaccg

SEQ ID NO: 1465 - DNA, 20 bp, Artificial Sequence
  Synthetic construct
gcgtctgatgaaagcaccga

SEQ ID NO: 1466 - DNA, 20 bp, Artificial Sequence
  Synthetic construct
cgtctgatgaaagcaccgac

SEQ ID NO: 1467 - DNA, 20 bp, Artificial Sequence
  Synthetic construct
gtctgatgaaagcaccgacc

SEQ ID NO: 1468 - DNA, 20 bp, Artificial Sequence
  Synthetic construct
tctgatgaaagcaccgaccc

SEQ ID NO: 1469 - DNA, 20 bp, Artificial Sequence
  Synthetic construct
ctgatgaaagcaccgacccc

SEQ ID NO: 1470 - DNA, 20 bp, Artificial Sequence
  Synthetic construct
tgatgaaagcaccgacccct

SEQ ID NO: 1471 - DNA, 20 bp, Artificial Sequence
  Synthetic construct
gatgaaagcaccgacccctt

SEQ ID NO: 1472 - DNA, 20 bp, Artificial Sequence
  Synthetic construct
atgaaagcaccgaccccttt

SEQ ID NO: 1473 - DNA, 20 bp, Artificial Sequence
  Synthetic construct
tgaaagcaccgacccctttc

SEQ ID NO: 1474 - DNA, 20 bp, Artificial Sequence
  Synthetic construct
gaaagcaccgacccctttct

SEQ ID NO: 1475 - DNA, 20 bp, Artificial Sequence
  Synthetic construct
aaagcaccgacccctttctg

SEQ ID NO: 1476 - DNA, 20 bp, Artificial Sequence
  Synthetic construct
aagcaccgacccctttctgg

SEQ ID NO: 1477 - DNA, 20 bp, Artificial Sequence
  Synthetic construct
agcaccgacccctttctgga

SEQ ID NO: 1478 - DNA, 20 bp, Artificial Sequence
  Synthetic construct
gcaccgacccctttctggag

SEQ ID NO: 1479 - DNA, 20 bp, Artificial Sequence
  Synthetic construct
caccgacccctttctggagg

SEQ ID NO: 1480 - DNA, 20 bp, Artificial Sequence
  Synthetic construct
accgacccctttctggaggt

SEQ ID NO: 1481 - DNA, 20 bp, Artificial Sequence
  Synthetic construct
ccgacccctttctggaggta

SEQ ID NO: 1482 - DNA, 20 bp, Artificial Sequence
  Synthetic construct
cgacccctttctggaggtac

SEQ ID NO: 1483 - DNA, 20 bp, Artificial Sequence
  Synthetic construct
gacccctttctggaggtaca

SEQ ID NO: 1484 - DNA, 20 bp, Artificial Sequence
  Synthetic construct
acccctttctggaggtacat

SEQ ID NO: 1485 - DNA, 20 bp, Artificial Sequence
  Synthetic construct
cccctttctggaggtacata

SEQ ID NO: 1486 - DNA, 20 bp, Artificial Sequence
  Synthetic construct
ccctttctggaggtacatat

SEQ ID NO: 1487 - DNA, 20 bp, Artificial Sequence
  Synthetic construct
cctttctggaggtacatatt

SEQ ID NO: 1488 - DNA, 20 bp, Artificial Sequence
  Synthetic construct
ctttctggaggtacatattc

SEQ ID NO: 1489 - DNA, 20 bp, Artificial Sequence
  Synthetic construct
tttctggaggtacatattca

SEQ ID NO: 1490 - DNA, 20 bp, Artificial Sequence
  Synthetic construct
ttctggaggtacatattcat

SEQ ID NO: 1491 - DNA, 20 bp, Artificial Sequence
  Synthetic construct
tctggaggtacatattcata

SEQ ID NO: 1492 - DNA, 20 bp, Artificial Sequence
  Synthetic construct
ctggaggtacatattcatat

SEQ ID NO: 1493 - DNA, 20 bp, Artificial Sequence
  Synthetic construct
tggaggtacatattcatatc

SEQ ID NO: 1494 - DNA, 20 bp, Artificial Sequence
  Synthetic construct
ggaggtacatattcatatca

SEQ ID NO: 1495 - DNA, 20 bp, Artificial Sequence
  Synthetic construct
gaggtacatattcatatcag

SEQ ID NO: 1496 - DNA, 20 bp, Artificial Sequence
  Synthetic construct
aggtacatattcatatcagg

SEQ ID NO: 1497 - DNA, 20 bp, Artificial Sequence
  Synthetic construct
ggtacatattcatatcaggc

SEQ ID NO: 1498 - DNA, 20 bp, Artificial Sequence
  Synthetic construct
gtacatattcatatcaggct

SEQ ID NO: 1499 - DNA, 20 bp, Artificial Sequence
  Synthetic construct
tacatattcatatcaggctc

SEQ ID NO: 1500 - DNA, 20 bp, Artificial Sequence
  Synthetic construct
acatattcatatcaggctcc

SEQ ID NO: 1501 - DNA, 20 bp, Artificial Sequence
  Synthetic construct
catattcatatcaggctcct

SEQ ID NO: 1502 - DNA, 20 bp, Artificial Sequence
  Synthetic construct
atattcatatcaggctcctt

SEQ ID NO: 1503 - DNA, 20 bp, Artificial Sequence
  Synthetic construct
tattcatatcaggctcctta

SEQ ID NO: 1504 - DNA, 20 bp, Artificial Sequence
  Synthetic construct
attcatatcaggctccttac

SEQ ID NO: 1505 - DNA, 20 bp, Artificial Sequence
  Synthetic construct
ttcatatcaggctccttaca

SEQ ID NO: 1506 - DNA, 20 bp, Artificial Sequence
  Synthetic construct
tcatatcaggctccttacag

SEQ ID NO: 1507 - DNA, 20 bp, Artificial Sequence
  Synthetic construct
catatcaggctccttacagg

SEQ ID NO: 1508 - DNA, 20 bp, Artificial Sequence
  Synthetic construct
atatcaggctccttacaggc

SEQ ID NO: 1509 - DNA, 20 bp, Artificial Sequence
  Synthetic construct
tatcaggctccttacaggca

SEQ ID NO: 1510 - DNA, 20 bp, Artificial Sequence
  Synthetic construct
atcaggctccttacaggcag

SEQ ID NO: 1511 - DNA, 20 bp, Artificial Sequence
  Synthetic construct
tcaggctccttacaggcagc

SEQ ID NO: 1512 - DNA, 20 bp, Artificial Sequence
  Synthetic construct
caggctccttacaggcagcc

SEQ ID NO: 1513 - DNA, 20 bp, Artificial Sequence
  Synthetic construct
aggctccttacaggcagccc

SEQ ID NO: 1514 - DNA, 20 bp, Artificial Sequence
  Synthetic construct
ggctccttacaggcagcccg

SEQ ID NO: 1515 - DNA, 20 bp, Artificial Sequence
  Synthetic construct
gctccttacaggcagcccga

SEQ ID NO: 1516 - DNA, 20 bp, Artificial Sequence
  Synthetic construct
ctccttacaggcagcccgat

SEQ ID NO: 1517 - DNA, 20 bp, Artificial Sequence
  Synthetic construct
tccttacaggcagcccgatc

SEQ ID NO: 1518 - DNA, 20 bp, Artificial Sequence
  Synthetic construct
ccttacaggcagcccgatct

SEQ ID NO: 1519 - DNA, 20 bp, Artificial Sequence
  Synthetic construct
cttacaggcagcccgatcta

SEQ ID NO: 1520 - DNA, 20 bp, Artificial Sequence
  Synthetic construct
ttacaggcagcccgatctat

SEQ ID NO: 1521 - DNA, 20 bp, Artificial Sequence
  Synthetic construct
tacaggcagcccgatctatt

SEQ ID NO: 1522 - DNA, 20 bp, Artificial Sequence
  Synthetic construct
acaggcagcccgatctattt

SEQ ID NO: 1523 - DNA, 20 bp, Artificial Sequence
  Synthetic construct
caggcagcccgatctatttt

SEQ ID NO: 1524 - DNA, 20 bp, Artificial Sequence
  Synthetic construct
aggcagcccgatctatttta

SEQ ID NO: 1525 - DNA, 20 bp, Artificial Sequence
  Synthetic construct
ggcagcccgatctattttat

SEQ ID NO: 1526 - DNA, 20 bp, Artificial Sequence
  Synthetic construct
gcagcccgatctattttatt

SEQ ID NO: 1527 - DNA, 20 bp, Artificial Sequence
  Synthetic construct
cagcccgatctattttatta

SEQ ID NO: 1528 - DNA, 20 bp, Artificial Sequence
  Synthetic construct
agcccgatctattttattat

SEQ ID NO: 1529 - DNA, 20 bp, Artificial Sequence
  Synthetic construct
gcccgatctattttattatt

SEQ ID NO: 1530 - DNA, 20 bp, Artificial Sequence
  Synthetic construct
cccgatctattttattattc

SEQ ID NO: 1531 - DNA, 20 bp, Artificial Sequence
  Synthetic construct
ccgatctattttattattct

SEQ ID NO: 1532 - DNA, 20 bp, Artificial Sequence
  Synthetic construct
cgatctattttattattctt

SEQ ID NO: 1533 - DNA, 20 bp, Artificial Sequence
  Synthetic construct
gatctattttattattcttc

SEQ ID NO: 1534 - DNA, 20 bp, Artificial Sequence
  Synthetic construct
atctattttattattcttcg

SEQ ID NO: 1535 - DNA, 20 bp, Artificial Sequence
  Synthetic construct
tctattttattattcttcgg

SEQ ID NO: 1536 - DNA, 20 bp, Artificial Sequence
  Synthetic construct
ctattttattattcttcgga

SEQ ID NO: 1537 - DNA, 20 bp, Artificial Sequence
  Synthetic construct
tattttattattcttcggaa

SEQ ID NO: 1538 - DNA, 20 bp, Artificial Sequence
  Synthetic construct
attttattattcttcggaac

SEQ ID NO: 1539 - DNA, 20 bp, Artificial Sequence
  Synthetic construct
ttttattattcttcggaact

SEQ ID NO: 1540 - DNA, 20 bp, Artificial Sequence
  Synthetic construct
tttattattcttcggaactg

SEQ ID NO: 1541 - DNA, 20 bp, Artificial Sequence
  Synthetic construct
ttattattcttcggaactgt

SEQ ID NO: 1542 - DNA, 20 bp, Artificial Sequence
  Synthetic construct
tattattcttcggaactgta

SEQ ID NO: 1543 - DNA, 20 bp, Artificial Sequence
  Synthetic construct
attattcttcggaactgtaa

SEQ ID NO: 1544 - DNA, 20 bp, Artificial Sequence
  Synthetic construct
ttattcttcggaactgtaaa

SEQ ID NO: 1545 - DNA, 20 bp, Artificial Sequence
  Synthetic construct
tattcttcggaactgtaaac

SEQ ID NO: 1546 - DNA, 20 bp, Artificial Sequence
  Synthetic construct
attcttcggaactgtaaaca

SEQ ID NO: 1547 - DNA, 20 bp, Artificial Sequence
  Synthetic construct
ttcttcggaactgtaaacac

SEQ ID NO: 1548 - DNA, 20 bp, Artificial Sequence
  Synthetic construct
tcttcggaactgtaaacact

SEQ ID NO: 1549 - DNA, 20 bp, Artificial Sequence
  Synthetic construct
cttcggaactgtaaacactc

SEQ ID NO: 1550 - DNA, 20 bp, Artificial Sequence
  Synthetic construct
ttcggaactgtaaacactcc

SEQ ID NO: 1551 - DNA, 20 bp, Artificial Sequence
  Synthetic construct
tcggaactgtaaacactccg

SEQ ID NO: 1552 - DNA, 20 bp, Artificial Sequence
  Synthetic construct
cggaactgtaaacactccgt

SEQ ID NO: 1553 - DNA, 20 bp, Artificial Sequence
  Synthetic construct
ggaactgtaaacactccgtt

SEQ ID NO: 1554 - DNA, 20 bp, Artificial Sequence
  Synthetic construct
gaactgtaaacactccgttc

SEQ ID NO: 1555 - DNA, 20 bp, Artificial Sequence
  Synthetic construct
aactgtaaacactccgttcc

SEQ ID NO: 1556 - DNA, 20 bp, Artificial Sequence
  Synthetic construct
actgtaaacactccgttccc

SEQ ID NO: 1557 - DNA, 20 bp, Artificial Sequence
  Synthetic construct
ctgtaaacactccgttccct

SEQ ID NO: 1558 - DNA, 20 bp, Artificial Sequence
  Synthetic construct
tgtaaacactccgttcccta

SEQ ID NO: 1559 - DNA, 20 bp, Artificial Sequence
  Synthetic construct
gtaaacactccgttccctac

SEQ ID NO: 1560 - DNA, 20 bp, Artificial Sequence
  Synthetic construct
taaacactccgttccctaca

SEQ ID NO: 1561 - DNA, 20 bp, Artificial Sequence
  Synthetic construct
aaacactccgttccctacaa

SEQ ID NO: 1562 - DNA, 20 bp, Artificial Sequence
  Synthetic construct
aacactccgttccctacaac

SEQ ID NO: 1563 - DNA, 20 bp, Artificial Sequence
  Synthetic construct
acactccgttccctacaacg

SEQ ID NO: 1564 - DNA, 20 bp, Artificial Sequence
  Synthetic construct
cactccgttccctacaacga

SEQ ID NO: 1565 - DNA, 20 bp, Artificial Sequence
  Synthetic construct
actccgttccctacaacgag

SEQ ID NO: 1566 - DNA, 20 bp, Artificial Sequence
  Synthetic construct
ctccgttccctacaacgagc

SEQ ID NO: 1567 - DNA, 20 bp, Artificial Sequence
  Synthetic construct
tccgttccctacaacgagcc

SEQ ID NO: 1568 - DNA, 20 bp, Artificial Sequence
  Synthetic construct
ccgttccctacaacgagcct

SEQ ID NO: 1569 - DNA, 20 bp, Artificial Sequence
  Synthetic construct
cgttccctacaacgagccta

SEQ ID NO: 1570 - DNA, 20 bp, Artificial Sequence
  Synthetic construct
gttccctacaacgagcctaa

SEQ ID NO: 1571 - DNA, 20 bp, Artificial Sequence
  Synthetic construct
ttccctacaacgagcctaaa

SEQ ID NO: 1572 - DNA, 20 bp, Artificial Sequence
  Synthetic construct
tccctacaacgagcctaaat

SEQ ID NO: 1573 - DNA, 20 bp, Artificial Sequence
  Synthetic construct
ccctacaacgagcctaaatt

SEQ ID NO: 1574 - DNA, 20 bp, Artificial Sequence
  Synthetic construct
cctacaacgagcctaaattc

SEQ ID NO: 1575 - DNA, 20 bp, Artificial Sequence
  Synthetic construct
ctacaacgagcctaaattca

SEQ ID NO: 1576 - DNA, 20 bp, Artificial Sequence
  Synthetic construct
tacaacgagcctaaattcat

SEQ ID NO: 1577 - DNA, 20 bp, Artificial Sequence
  Synthetic construct
acaacgagcctaaattcata

SEQ ID NO: 1578 - DNA, 20 bp, Artificial Sequence
  Synthetic construct
caacgagcctaaattcatat

SEQ ID NO: 1579 - DNA, 20 bp, Artificial Sequence
  Synthetic construct
aacgagcctaaattcatatg

SEQ ID NO: 1580 - DNA, 20 bp, Artificial Sequence
  Synthetic construct
acgagcctaaattcatatga

SEQ ID NO: 1581 - DNA, 20 bp, Artificial Sequence
  Synthetic construct
cgagcctaaattcatatgac

SEQ ID NO: 1582 - DNA, 20 bp, Artificial Sequence
  Synthetic construct
gagcctaaattcatatgact

SEQ ID NO: 1583 - DNA, 20 bp, Artificial Sequence
  Synthetic construct
agcctaaattcatatgactc

SEQ ID NO: 1584 - DNA, 20 bp, Artificial Sequence
  Synthetic construct
gcctaaattcatatgactcg

SEQ ID NO: 1585 - DNA, 20 bp, Artificial Sequence
  Synthetic construct
cctaaattcatatgactcgt

SEQ ID NO: 1586 - DNA, 20 bp, Artificial Sequence
  Synthetic construct
ctaaattcatatgactcgtt

SEQ ID NO: 1587 - DNA, 20 bp, Artificial Sequence
  Synthetic construct
taaattcatatgactcgtta

SEQ ID NO: 1588 - DNA, 20 bp, Artificial Sequence
  Synthetic construct
aaattcatatgactcgttat

SEQ ID NO: 1589 - DNA, 20 bp, Artificial Sequence
  Synthetic construct
aattcatatgactcgttata

SEQ ID NO: 1590 - DNA, 20 bp, Artificial Sequence
  Synthetic construct
attcatatgactcgttatag

SEQ ID NO: 1591 - DNA, 20 bp, Artificial Sequence
  Synthetic construct
ttcatatgactcgttatagc

SEQ ID NO: 1592 - DNA, 20 bp, Artificial Sequence
  Synthetic construct
tcatatgactcgttatagcg

SEQ ID NO: 1593 - DNA, 20 bp, Artificial Sequence
  Synthetic construct
catatgactcgttatagcgg

SEQ ID NO: 1594 - DNA, 20 bp, Artificial Sequence
  Synthetic construct
atatgactcgttatagcgga

SEQ ID NO: 1595 - DNA, 20 bp, Artificial Sequence
  Synthetic construct
tatgactcgttatagcggac

SEQ ID NO: 1596 - DNA, 20 bp, Artificial Sequence
  Synthetic construct
atgactcgttatagcggacc

SEQ ID NO: 1597 - DNA, 20 bp, Artificial Sequence
  Synthetic construct
tgactcgttatagcggaccg

SEQ ID NO: 1598 - DNA, 20 bp, Artificial Sequence
  Synthetic construct
gactcgttatagcggaccgc

SEQ ID NO: 1599 - DNA, 20 bp, Artificial Sequence
  Synthetic construct
actcgttatagcggaccgcg

SEQ ID NO: 1600 - DNA, 20 bp, Artificial Sequence
  Synthetic construct
ctcgttatagcggaccgcgt

SEQ ID NO: 1601 - DNA, 20 bp, Artificial Sequence
  Synthetic construct
tcgttatagcggaccgcgtg

SEQ ID NO: 1602 - DNA, 20 bp, Artificial Sequence
  Synthetic construct
cgttatagcggaccgcgtgt

SEQ ID NO: 1603 - DNA, 20 bp, Artificial Sequence
  Synthetic construct
gttatagcggaccgcgtgtc

SEQ ID NO: 1604 - DNA, 20 bp, Artificial Sequence
  Synthetic construct
ttatagcggaccgcgtgtct

SEQ ID NO: 1605 - DNA, 20 bp, Artificial Sequence
  Synthetic construct
tatagcggaccgcgtgtctg

SEQ ID NO: 1606 - DNA, 20 bp, Artificial Sequence
  Synthetic construct
atagcggaccgcgtgtctga

SEQ ID NO: 1607 - DNA, 20 bp, Artificial Sequence
  Synthetic construct
tagcggaccgcgtgtctgat

SEQ ID NO: 1608 - DNA, 20 bp, Artificial Sequence
  Synthetic construct
agcggaccgcgtgtctgatc

SEQ ID NO: 1609 - DNA, 20 bp, Artificial Sequence
  Synthetic construct
gcggaccgcgtgtctgatcc

SEQ ID NO: 1610 - DNA, 20 bp, Artificial Sequence
  Synthetic construct
cggaccgcgtgtctgatcca

SEQ ID NO: 1611 - DNA, 20 bp, Artificial Sequence
  Synthetic construct
ggaccgcgtgtctgatccac

SEQ ID NO: 1612 - DNA, 20 bp, Artificial Sequence
  Synthetic construct
gaccgcgtgtctgatccacg

SEQ ID NO: 1613 - DNA, 20 bp, Artificial Sequence
  Synthetic construct
accgcgtgtctgatccacgg

SEQ ID NO: 1614 - DNA, 20 bp, Artificial Sequence
  Synthetic construct
ccgcgtgtctgatccacggc

SEQ ID NO: 1615 - DNA, 20 bp, Artificial Sequence
  Synthetic construct
cgcgtgtctgatccacggcg

SEQ ID NO: 1616 - DNA, 20 bp, Artificial Sequence
  Synthetic construct
gcgtgtctgatccacggcgc

SEQ ID NO: 1617 - DNA, 20 bp, Artificial Sequence
  Synthetic construct
cgtgtctgatccacggcgca

SEQ ID NO: 1618 - DNA, 20 bp, Artificial Sequence
  Synthetic construct
gtgtctgatccacggcgcac

SEQ ID NO: 1619 - DNA, 20 bp, Artificial Sequence
  Synthetic construct
tgtctgatccacggcgcaca

SEQ ID NO: 1620 - DNA, 20 bp, Artificial Sequence
  Synthetic construct
gtctgatccacggcgcacat

SEQ ID NO: 1621 - DNA, 20 bp, Artificial Sequence
  Synthetic construct
tctgatccacggcgcacatt

SEQ ID NO: 1622 - DNA, 20 bp, Artificial Sequence
  Synthetic construct
ctgatccacggcgcacattg

SEQ ID NO: 1623 - DNA, 20 bp, Artificial Sequence
  Synthetic construct
tgatccacggcgcacattgg

SEQ ID NO: 1624 - DNA, 20 bp, Artificial Sequence
  Synthetic construct
gatccacggcgcacattggt

SEQ ID NO: 1625 - DNA, 20 bp, Artificial Sequence
  Synthetic construct
atccacggcgcacattggtc

SEQ ID NO: 1626 - DNA, 20 bp, Artificial Sequence
  Synthetic construct
tccacggcgcacattggtct

SEQ ID NO: 1627 - DNA, 20 bp, Artificial Sequence
  Synthetic construct
ccacggcgcacattggtctc

SEQ ID NO: 1628 - DNA, 20 bp, Artificial Sequence
  Synthetic construct
cacggcgcacattggtctcg

SEQ ID NO: 1629 - DNA, 20 bp, Artificial Sequence
  Synthetic construct
acggcgcacattggtctcgg

SEQ ID NO: 1630 - DNA, 20 bp, Artificial Sequence
  Synthetic construct
cggcgcacattggtctcgga

SEQ ID NO: 1631 - DNA, 20 bp, Artificial Sequence
  Synthetic construct
ggcgcacattggtctcggac

SEQ ID NO: 1632 - DNA, 20 bp, Artificial Sequence
  Synthetic construct
gcgcacattggtctcggacc

SEQ ID NO: 1633 - DNA, 20 bp, Artificial Sequence
  Synthetic construct
cgcacattggtctcggacca

SEQ ID NO: 1634 - DNA, 20 bp, Artificial Sequence
  Synthetic construct
gcacattggtctcggaccaa

SEQ ID NO: 1635 - DNA, 20 bp, Artificial Sequence
  Synthetic construct
cacattggtctcggaccaat

SEQ ID NO: 1636 - DNA, 20 bp, Artificial Sequence
  Synthetic construct
acattggtctcggaccaata

SEQ ID NO: 1637 - DNA, 20 bp, Artificial Sequence
  Synthetic construct
cattggtctcggaccaatag

SEQ ID NO: 1638 - DNA, 20 bp, Artificial Sequence
  Synthetic construct
attggtctcggaccaataga

SEQ ID NO: 1639 - DNA, 20 bp, Artificial Sequence
  Synthetic construct
ttggtctcggaccaatagag

SEQ ID NO: 1640 - DNA, 20 bp, Artificial Sequence
  Synthetic construct
tggtctcggaccaatagagc

SEQ ID NO: 1641 - DNA, 20 bp, Artificial Sequence
  Synthetic construct
ggtctcggaccaatagagcc

SEQ ID NO: 1642 - DNA, 20 bp, Artificial Sequence
  Synthetic construct
gtctcggaccaatagagccg

SEQ ID NO: 1643 - DNA, 20 bp, Artificial Sequence
  Synthetic construct
tctcggaccaatagagccgc

SEQ ID NO: 1644 - DNA, 20 bp, Artificial Sequence
  Synthetic construct
ctcggaccaatagagccgct

SEQ ID NO: 1645 - DNA, 20 bp, Artificial Sequence
  Synthetic construct
tcggaccaatagagccgctc

SEQ ID NO: 1646 - DNA, 20 bp, Artificial Sequence
  Synthetic construct
cggaccaatagagccgctct

SEQ ID NO: 1647 - DNA, 20 bp, Artificial Sequence
  Synthetic construct
ggaccaatagagccgctctc

SEQ ID NO: 1648 - DNA, 20 bp, Artificial Sequence
  Synthetic construct
gaccaatagagccgctctca

SEQ ID NO: 1649 - DNA, 20 bp, Artificial Sequence
  Synthetic construct
accaatagagccgctctcag

SEQ ID NO: 1650 - DNA, 20 bp, Artificial Sequence
  Synthetic construct
ccaatagagccgctctcaga

SEQ ID NO: 1651 - DNA, 20 bp, Artificial Sequence
  Synthetic construct
caatagagccgctctcagag

SEQ ID NO: 1652 - DNA, 20 bp, Artificial Sequence
  Synthetic construct
aatagagccgctctcagagc

SEQ ID NO: 1653 - DNA, 20 bp, Artificial Sequence
  Synthetic construct
atagagccgctctcagagcg

SEQ ID NO: 1654 - DNA, 20 bp, Artificial Sequence
  Synthetic construct
tagagccgctctcagagcgc

SEQ ID NO: 1655 - DNA, 20 bp, Artificial Sequence
  Synthetic construct
agagccgctctcagagcgcg

SEQ ID NO: 1656 - DNA, 20 bp, Artificial Sequence
  Synthetic construct
gagccgctctcagagcgcgg

SEQ ID NO: 1657 - DNA, 20 bp, Artificial Sequence
  Synthetic construct
agccgctctcagagcgcggg

SEQ ID NO: 1658 - DNA, 20 bp, Artificial Sequence
  Synthetic construct
gccgctctcagagcgcgggg

SEQ ID NO: 1659 - DNA, 20 bp, Artificial Sequence
  Synthetic construct
ccgctctcagagcgcggggg

SEQ ID NO: 1660 - DNA, 20 bp, Artificial Sequence
  Synthetic construct
cgctctcagagcgcgggggg

SEQ ID NO: 1661 - DNA, 20 bp, Artificial Sequence
  Synthetic construct
gctctcagagcgcggggggt

SEQ ID NO: 1662 - DNA, 20 bp, Artificial Sequence
  Synthetic construct
ctctcagagcgcggggggta

SEQ ID NO: 1663 - DNA, 20 bp, Artificial Sequence
  Synthetic construct
tctcagagcgcggggggtaa

SEQ ID NO: 1664 - DNA, 20 bp, Artificial Sequence
  Synthetic construct
ctcagagcgcggggggtaac

SEQ ID NO: 1665 - DNA, 20 bp, Artificial Sequence
  Synthetic construct
tcagagcgcggggggtaacg

SEQ ID NO: 1666 - DNA, 20 bp, Artificial Sequence
  Synthetic construct
cagagcgcggggggtaacgg

SEQ ID NO: 1667 - DNA, 20 bp, Artificial Sequence
  Synthetic construct
agagcgcggggggtaacggt

SEQ ID NO: 1668 - DNA, 20 bp, Artificial Sequence
  Synthetic construct
gagcgcggggggtaacggtt

SEQ ID NO: 1669 - DNA, 20 bp, Artificial Sequence
  Synthetic construct
agcgcggggggtaacggttg

SEQ ID NO: 1670 - DNA, 20 bp, Artificial Sequence
  Synthetic construct
gcgcggggggtaacggttgc

SEQ ID NO: 1671 - DNA, 20 bp, Artificial Sequence
  Synthetic construct
cgcggggggtaacggttgct

SEQ ID NO: 1672 - DNA, 20 bp, Artificial Sequence
  Synthetic construct
gcggggggtaacggttgctt

SEQ ID NO: 1673 - DNA, 20 bp, Artificial Sequence
  Synthetic construct
cggggggtaacggttgcttg

SEQ ID NO: 1674 - DNA, 20 bp, Artificial Sequence
  Synthetic construct
ggggggtaacggttgcttgt

SEQ ID NO: 1675 - DNA, 20 bp, Artificial Sequence
  Synthetic construct
gggggtaacggttgcttgtt

SEQ ID NO: 1676 - DNA, 20 bp, Artificial Sequence
  Synthetic construct
ggggtaacggttgcttgttc

SEQ ID NO: 1677 - DNA, 20 bp, Artificial Sequence
  Synthetic construct
gggtaacggttgcttgttca

SEQ ID NO: 1678 - DNA, 20 bp, Artificial Sequence
  Synthetic construct
ggtaacggttgcttgttcag

SEQ ID NO: 1679 - DNA, 20 bp, Artificial Sequence
  Synthetic construct
gtaacggttgcttgttcagc

SEQ ID NO: 1680 - DNA, 20 bp, Artificial Sequence
  Synthetic construct
taacggttgcttgttcagcg

SEQ ID NO: 1681 - DNA, 20 bp, Artificial Sequence
  Synthetic construct
aacggttgcttgttcagcga

SEQ ID NO: 1682 - DNA, 20 bp, Artificial Sequence
  Synthetic construct
acggttgcttgttcagcgaa

SEQ ID NO: 1683 - DNA, 20 bp, Artificial Sequence
  Synthetic construct
cggttgcttgttcagcgaac

SEQ ID NO: 1684 - DNA, 20 bp, Artificial Sequence
  Synthetic construct
ggttgcttgttcagcgaact

SEQ ID NO: 1685 - DNA, 20 bp, Artificial Sequence
  Synthetic construct
gttgcttgttcagcgaactt

SEQ ID NO: 1686 - DNA, 20 bp, Artificial Sequence
  Synthetic construct
ttgcttgttcagcgaacttc

SEQ ID NO: 1687 - DNA, 20 bp, Artificial Sequence
  Synthetic construct
tgcttgttcagcgaacttct

SEQ ID NO: 1688 - DNA, 20 bp, Artificial Sequence
  Synthetic construct
gcttgttcagcgaacttctt

SEQ ID NO: 1689 - DNA, 20 bp, Artificial Sequence
  Synthetic construct
cttgttcagcgaacttcttg

SEQ ID NO: 1690 - DNA, 20 bp, Artificial Sequence
  Synthetic construct
ttgttcagcgaacttcttgt

SEQ ID NO: 1691 - DNA, 20 bp, Artificial Sequence
  Synthetic construct
tgttcagcgaacttcttgta

SEQ ID NO: 1692 - DNA, 20 bp, Artificial Sequence
  Synthetic construct
gttcagcgaacttcttgtaa

SEQ ID NO: 1693 - DNA, 20 bp, Artificial Sequence
  Synthetic construct
ttcagcgaacttcttgtaag

SEQ ID NO: 1694 - DNA, 20 bp, Artificial Sequence
  Synthetic construct
tcagcgaacttcttgtaagg

SEQ ID NO: 1695 - DNA, 20 bp, Artificial Sequence
  Synthetic construct
cagcgaacttcttgtaaggc

SEQ ID NO: 1696 - DNA, 20 bp, Artificial Sequence
  Synthetic construct
agcgaacttcttgtaaggcg

SEQ ID NO: 1697 - DNA, 20 bp, Artificial Sequence
  Synthetic construct
gcgaacttcttgtaaggcgc

SEQ ID NO: 1698 - DNA, 20 bp, Artificial Sequence
  Synthetic construct
cgaacttcttgtaaggcgct

SEQ ID NO: 1699 - DNA, 20 bp, Artificial Sequence
  Synthetic construct
gaacttcttgtaaggcgctg

SEQ ID NO: 1700 - DNA, 20 bp, Artificial Sequence
  Synthetic construct
aacttcttgtaaggcgctgc

SEQ ID NO: 1701 - DNA, 20 bp, Artificial Sequence
  Synthetic construct
acttcttgtaaggcgctgca

SEQ ID NO: 1702 - DNA, 20 bp, Artificial Sequence
  Synthetic construct
cttcttgtaaggcgctgcat

SEQ ID NO: 1703 - DNA, 20 bp, Artificial Sequence
  Synthetic construct
ttcttgtaaggcgctgcatc

SEQ ID NO: 1704 - DNA, 20 bp, Artificial Sequence
  Synthetic construct
tcttgtaaggcgctgcatcc

SEQ ID NO: 1705 - DNA, 20 bp, Artificial Sequence
  Synthetic construct
cttgtaaggcgctgcatcct

SEQ ID NO: 1706 - DNA, 20 bp, Artificial Sequence
  Synthetic construct
ttgtaaggcgctgcatcctg

SEQ ID NO: 1707 - DNA, 20 bp, Artificial Sequence
  Synthetic construct
tgtaaggcgctgcatcctgc

SEQ ID NO: 1708 - DNA, 20 bp, Artificial Sequence
  Synthetic construct
gtaaggcgctgcatcctgca

SEQ ID NO: 1709 - DNA, 20 bp, Artificial Sequence
  Synthetic construct
taaggcgctgcatcctgcaa

SEQ ID NO: 1710 - DNA, 20 bp, Artificial Sequence
  Synthetic construct
aaggcgctgcatcctgcaac

SEQ ID NO: 1711 - DNA, 20 bp, Artificial Sequence
  Synthetic construct
aggcgctgcatcctgcaact

SEQ ID NO: 1712 - DNA, 20 bp, Artificial Sequence
  Synthetic construct
ggcgctgcatcctgcaactt

SEQ ID NO: 1713 - DNA, 20 bp, Artificial Sequence
  Synthetic construct
gcgctgcatcctgcaacttg

SEQ ID NO: 1714 - DNA, 20 bp, Artificial Sequence
  Synthetic construct
cgctgcatcctgcaacttgt

SEQ ID NO: 1715 - DNA, 20 bp, Artificial Sequence
  Synthetic construct
gctgcatcctgcaacttgtg

SEQ ID NO: 1716 - DNA, 20 bp, Artificial Sequence
  Synthetic construct
ctgcatcctgcaacttgtgc

SEQ ID NO: 1717 - DNA, 20 bp, Artificial Sequence
  Synthetic construct
tgcatcctgcaacttgtgcc

SEQ ID NO: 1718 - DNA, 20 bp, Artificial Sequence
  Synthetic construct
gcatcctgcaacttgtgccc

SEQ ID NO: 1719 - DNA, 20 bp, Artificial Sequence
  Synthetic construct
catcctgcaacttgtgcccc

SEQ ID NO: 1720 - DNA, 20 bp, Artificial Sequence
  Synthetic construct
atcctgcaacttgtgcccca

SEQ ID NO: 1721 - DNA, 20 bp, Artificial Sequence
  Synthetic construct
tcctgcaacttgtgccccat

SEQ ID NO: 1722 - DNA, 20 bp, Artificial Sequence
  Synthetic construct
cctgcaacttgtgccccata

SEQ ID NO: 1723 - DNA, 20 bp, Artificial Sequence
  Synthetic construct
ctgcaacttgtgccccatag

SEQ ID NO: 1724 - DNA, 20 bp, Artificial Sequence
  Synthetic construct
tgcaacttgtgccccatagg

SEQ ID NO: 1725 - DNA, 20 bp, Artificial Sequence
  Synthetic construct
gcaacttgtgccccatagga

SEQ ID NO: 1726 - DNA, 20 bp, Artificial Sequence
  Synthetic construct
caacttgtgccccataggag

SEQ ID NO: 1727 - DNA, 20 bp, Artificial Sequence
  Synthetic construct
aacttgtgccccataggagc

SEQ ID NO: 1728 - DNA, 20 bp, Artificial Sequence
  Synthetic construct
acttgtgccccataggagca

SEQ ID NO: 1729 - DNA, 20 bp, Artificial Sequence
  Synthetic construct
cttgtgccccataggagcac

SEQ ID NO: 1730 - DNA, 20 bp, Artificial Sequence
  Synthetic construct
ttgtgccccataggagcacc

SEQ ID NO: 1731 - DNA, 20 bp, Artificial Sequence
  Synthetic construct
tgtgccccataggagcaccg

SEQ ID NO: 1732 - DNA, 20 bp, Artificial Sequence
  Synthetic construct
gtgccccataggagcaccgt

SEQ ID NO: 1733 - DNA, 20 bp, Artificial Sequence
  Synthetic construct
tgccccataggagcaccgtt

SEQ ID NO: 1734 - DNA, 20 bp, Artificial Sequence
  Synthetic construct
gccccataggagcaccgttg

SEQ ID NO: 1735 - DNA, 20 bp, Artificial Sequence
  Synthetic construct
ccccataggagcaccgttgg

SEQ ID NO: 1736 - DNA, 20 bp, Artificial Sequence
  Synthetic construct
cccataggagcaccgttgga

SEQ ID NO: 1737 - DNA, 20 bp, Artificial Sequence
  Synthetic construct
ccataggagcaccgttggag

SEQ ID NO: 1738 - DNA, 20 bp, Artificial Sequence
  Synthetic construct
cataggagcaccgttggaga

SEQ ID NO: 1739 - DNA, 20 bp, Artificial Sequence
  Synthetic construct
ataggagcaccgttggagaa

SEQ ID NO: 1740 - DNA, 20 bp, Artificial Sequence
  Synthetic construct
taggagcaccgttggagaac

SEQ ID NO: 1741 - DNA, 20 bp, Artificial Sequence
  Synthetic construct
aggagcaccgttggagaacg

SEQ ID NO: 1742 - DNA, 20 bp, Artificial Sequence
  Synthetic construct
ggagcaccgttggagaacgt

SEQ ID NO: 1743 - DNA, 20 bp, Artificial Sequence
  Synthetic construct
gagcaccgttggagaacgtg

SEQ ID NO: 1744 - DNA, 20 bp, Artificial Sequence
  Synthetic construct
agcaccgttggagaacgtgc

SEQ ID NO: 1745 - DNA, 20 bp, Artificial Sequence
  Synthetic construct
gcaccgttggagaacgtgca

SEQ ID NO: 1746 - DNA, 20 bp, Artificial Sequence
  Synthetic construct
caccgttggagaacgtgcat

SEQ ID NO: 1747 - DNA, 20 bp, Artificial Sequence
  Synthetic construct
accgttggagaacgtgcatt

SEQ ID NO: 1748 - DNA, 20 bp, Artificial Sequence
  Synthetic construct
ccgttggagaacgtgcattg

SEQ ID NO: 1749 - DNA, 20 bp, Artificial Sequence
  Synthetic construct
cgttggagaacgtgcattgc

SEQ ID NO: 1750 - DNA, 20 bp, Artificial Sequence
  Synthetic construct
gttggagaacgtgcattgcc

SEQ ID NO: 1751 - DNA, 20 bp, Artificial Sequence
  Synthetic construct
ttggagaacgtgcattgccc

SEQ ID NO: 1752 - DNA, 20 bp, Artificial Sequence
  Synthetic construct
tggagaacgtgcattgccca

SEQ ID NO: 1753 - DNA, 20 bp, Artificial Sequence
  Synthetic construct
ggagaacgtgcattgcccaa

SEQ ID NO: 1754 - DNA, 20 bp, Artificial Sequence
  Synthetic construct
gagaacgtgcattgcccaaa

SEQ ID NO: 1755 - DNA, 20 bp, Artificial Sequence
  Synthetic construct
agaacgtgcattgcccaaac

SEQ ID NO: 1756 - DNA, 20 bp, Artificial Sequence
  Synthetic construct
gaacgtgcattgcccaaaca

SEQ ID NO: 1757 - DNA, 20 bp, Artificial Sequence
  Synthetic construct
aacgtgcattgcccaaacaa

SEQ ID NO: 1758 - DNA, 20 bp, Artificial Sequence
  Synthetic construct
acgtgcattgcccaaacaac

SEQ ID NO: 1759 - DNA, 20 bp, Artificial Sequence
  Synthetic construct
cgtgcattgcccaaacaacg

SEQ ID NO: 1760 - DNA, 20 bp, Artificial Sequence
  Synthetic construct
gtgcattgcccaaacaacga

SEQ ID NO: 1761 - DNA, 20 bp, Artificial Sequence
  Synthetic construct
tgcattgcccaaacaacgac

SEQ ID NO: 1762 - DNA, 20 bp, Artificial Sequence
  Synthetic construct
gcattgcccaaacaacgacg

SEQ ID NO: 1763 - DNA, 20 bp, Artificial Sequence
  Synthetic construct
cattgcccaaacaacgacga

SEQ ID NO: 1764 - DNA, 20 bp, Artificial Sequence
  Synthetic construct
attgcccaaacaacgacgat

SEQ ID NO: 1765 - DNA, 20 bp, Artificial Sequence
  Synthetic construct
ttgcccaaacaacgacgatc

SEQ ID NO: 1766 - DNA, 20 bp, Artificial Sequence
  Synthetic construct
tgcccaaacaacgacgatcg

SEQ ID NO: 1767 - DNA, 20 bp, Artificial Sequence
  Synthetic construct
gcccaaacaacgacgatcgg

SEQ ID NO: 1768 - DNA, 20 bp, Artificial Sequence
  Synthetic construct
cccaaacaacgacgatcggt

SEQ ID NO: 1769 - DNA, 20 bp, Artificial Sequence
  Synthetic construct
ccaaacaacgacgatcggta

SEQ ID NO: 1770 - DNA, 20 bp, Artificial Sequence
  Synthetic construct
caaacaacgacgatcggtag

SEQ ID NO: 1771 - DNA, 20 bp, Artificial Sequence
  Synthetic construct
aaacaacgacgatcggtagc

SEQ ID NO: 1772 - DNA, 20 bp, Artificial Sequence
  Synthetic construct
aacaacgacgatcggtagcc

SEQ ID NO: 1773 - DNA, 20 bp, Artificial Sequence
  Synthetic construct
acaacgacgatcggtagcca

SEQ ID NO: 1774 - DNA, 20 bp, Artificial Sequence
  Synthetic construct
caacgacgatcggtagccag

SEQ ID NO: 1775 - DNA, 20 bp, Artificial Sequence
  Synthetic construct
aacgacgatcggtagccaga

SEQ ID NO: 1776 - DNA, 20 bp, Artificial Sequence
  Synthetic construct
acgacgatcggtagccagag

SEQ ID NO: 1777 - DNA, 20 bp, Artificial Sequence
  Synthetic construct
cgacgatcggtagccagaga

SEQ ID NO: 1778 - DNA, 20 bp, Artificial Sequence
  Synthetic construct
gacgatcggtagccagagag

SEQ ID NO: 1779 - DNA, 20 bp, Artificial Sequence
  Synthetic construct
acgatcggtagccagagagg

SEQ ID NO: 1780 - DNA, 20 bp, Artificial Sequence
  Synthetic construct
cgatcggtagccagagagga

SEQ ID NO: 1781 - DNA, 20 bp, Artificial Sequence
  Synthetic construct
gatcggtagccagagaggag

SEQ ID NO: 1782 - DNA, 20 bp, Artificial Sequence
  Synthetic construct
atcggtagccagagaggagg

SEQ ID NO: 1783 - DNA, 20 bp, Artificial Sequence
  Synthetic construct
tcggtagccagagaggaggt

SEQ ID NO: 1784 - DNA, 20 bp, Artificial Sequence
  Synthetic construct
cggtagccagagaggaggtt

SEQ ID NO: 1785 - DNA, 20 bp, Artificial Sequence
  Synthetic construct
ggtagccagagaggaggttg

SEQ ID NO: 1786 - DNA, 20 bp, Artificial Sequence
  Synthetic construct
gtagccagagaggaggttgc

SEQ ID NO: 1787 - DNA, 20 bp, Artificial Sequence
  Synthetic construct
tagccagagaggaggttgcc

SEQ ID NO: 1788 - DNA, 20 bp, Artificial Sequence
  Synthetic construct
agccagagaggaggttgcca

SEQ ID NO: 1789 - DNA, 20 bp, Artificial Sequence
  Synthetic construct
gccagagaggaggttgccaa

SEQ ID NO: 1790 - DNA, 20 bp, Artificial Sequence
  Synthetic construct
ccagagaggaggttgccaat

SEQ ID NO: 1791 - DNA, 20 bp, Artificial Sequence
  Synthetic construct
cagagaggaggttgccaata

SEQ ID NO: 1792 - DNA, 20 bp, Artificial Sequence
  Synthetic construct
agagaggaggttgccaataa

SEQ ID NO: 1793 - DNA, 20 bp, Artificial Sequence
  Synthetic construct
gagaggaggttgccaataag

SEQ ID NO: 1794 - DNA, 20 bp, Artificial Sequence
  Synthetic construct
agaggaggttgccaataagg

SEQ ID NO: 1795 - DNA, 20 bp, Artificial Sequence
  Synthetic construct
gaggaggttgccaataaggc

SEQ ID NO: 1796 - DNA, 20 bp, Artificial Sequence
  Synthetic construct
aggaggttgccaataaggct

SEQ ID NO: 1797 - DNA, 20 bp, Artificial Sequence
  Synthetic construct
ggaggttgccaataaggcta

SEQ ID NO: 1798 - DNA, 20 bp, Artificial Sequence
  Synthetic construct
gaggttgccaataaggctac

SEQ ID NO: 1799 - DNA, 20 bp, Artificial Sequence
  Synthetic construct
aggttgccaataaggctacg

SEQ ID NO: 1800 - DNA, 20 bp, Artificial Sequence
  Synthetic construct
ggttgccaataaggctacgg

SEQ ID NO: 1801 - DNA, 20 bp, Artificial Sequence
  Synthetic construct
gttgccaataaggctacgga

SEQ ID NO: 1802 - DNA, 20 bp, Artificial Sequence
  Synthetic construct
ttgccaataaggctacggat

SEQ ID NO: 1803 - DNA, 20 bp, Artificial Sequence
  Synthetic construct
tgccaataaggctacggatg

SEQ ID NO: 1804 - DNA, 20 bp, Artificial Sequence
  Synthetic construct
gccaataaggctacggatgc

SEQ ID NO: 1805 - DNA, 20 bp, Artificial Sequence
  Synthetic construct
ccaataaggctacggatgct

SEQ ID NO: 1806 - DNA, 20 bp, Artificial Sequence
  Synthetic construct
caataaggctacggatgctg

SEQ ID NO: 1807 - DNA, 20 bp, Artificial Sequence
  Synthetic construct
aataaggctacggatgctgg

SEQ ID NO: 1808 - DNA, 20 bp, Artificial Sequence
  Synthetic construct
ataaggctacggatgctggt

SEQ ID NO: 1809 - DNA, 20 bp, Artificial Sequence
  Synthetic construct
taaggctacggatgctggtt

SEQ ID NO: 1810 - DNA, 20 bp, Artificial Sequence
  Synthetic construct
aaggctacggatgctggttt

SEQ ID NO: 1811 - DNA, 20 bp, Artificial Sequence
  Synthetic construct
aggctacggatgctggtttg

SEQ ID NO: 1812 - DNA, 20 bp, Artificial Sequence
  Synthetic construct
ggctacggatgctggtttgt

SEQ ID NO: 1813 - DNA, 20 bp, Artificial Sequence
  Synthetic construct
gctacggatgctggtttgta

SEQ ID NO: 1814 - DNA, 20 bp, Artificial Sequence
  Synthetic construct
ctacggatgctggtttgtaa

SEQ ID NO: 1815 - DNA, 20 bp, Artificial Sequence
  Synthetic construct
tacggatgctggtttgtaaa

SEQ ID NO: 1816 - DNA, 20 bp, Artificial Sequence
  Synthetic construct
acggatgctggtttgtaaaa

SEQ ID NO: 1817 - DNA, 20 bp, Artificial Sequence
  Synthetic construct
cggatgctggtttgtaaaac

SEQ ID NO: 1818 - DNA, 20 bp, Artificial Sequence
  Synthetic construct
ggatgctggtttgtaaaaca

SEQ ID NO: 1819 - DNA, 20 bp, Artificial Sequence
  Synthetic construct
gatgctggtttgtaaaacat

SEQ ID NO: 1820 - DNA, 20 bp, Artificial Sequence
  Synthetic construct
atgctggtttgtaaaacatc

SEQ ID NO: 1821 - DNA, 20 bp, Artificial Sequence
  Synthetic construct
tgctggtttgtaaaacatcc

SEQ ID NO: 1822 - DNA, 20 bp, Artificial Sequence
  Synthetic construct
gctggtttgtaaaacatccg

SEQ ID NO: 1823 - DNA, 20 bp, Artificial Sequence
  Synthetic construct
ctggtttgtaaaacatccgg

SEQ ID NO: 1824 - DNA, 20 bp, Artificial Sequence
  Synthetic construct
tggtttgtaaaacatccgga

SEQ ID NO: 1825 - DNA, 20 bp, Artificial Sequence
  Synthetic construct
ggtttgtaaaacatccggat

SEQ ID NO: 1826 - DNA, 20 bp, Artificial Sequence
  Synthetic construct
gtttgtaaaacatccggatc

SEQ ID NO: 1827 - DNA, 20 bp, Artificial Sequence
  Synthetic construct
tttgtaaaacatccggatcc

SEQ ID NO: 1828 - DNA, 20 bp, Artificial Sequence
  Synthetic construct
ttgtaaaacatccggatccc

SEQ ID NO: 1829 - DNA, 20 bp, Artificial Sequence
  Synthetic construct
tgtaaaacatccggatccca

SEQ ID NO: 1830 - DNA, 20 bp, Artificial Sequence
  Synthetic construct
gtaaaacatccggatcccat

SEQ ID NO: 1831 - DNA, 20 bp, Artificial Sequence
  Synthetic construct
taaaacatccggatcccatg

SEQ ID NO: 1832 - DNA, 20 bp, Artificial Sequence
  Synthetic construct
aaaacatccggatcccatga

SEQ ID NO: 1833 - DNA, 20 bp, Artificial Sequence
  Synthetic construct
aaacatccggatcccatgac

SEQ ID NO: 1834 - DNA, 20 bp, Artificial Sequence
  Synthetic construct
aacatccggatcccatgaca

SEQ ID NO: 1835 - DNA, 20 bp, Artificial Sequence
  Synthetic construct
acatccggatcccatgacaa

SEQ ID NO: 1836 - DNA, 20 bp, Artificial Sequence
  Synthetic construct
catccggatcccatgacaag

SEQ ID NO: 1837 - DNA, 20 bp, Artificial Sequence
  Synthetic construct
atccggatcccatgacaagg

SEQ ID NO: 1838 - DNA, 20 bp, Artificial Sequence
  Synthetic construct
tccggatcccatgacaagga

SEQ ID NO: 1839 - DNA, 20 bp, Artificial Sequence
  Synthetic construct
ccggatcccatgacaaggat

SEQ ID NO: 1840 - DNA, 20 bp, Artificial Sequence
  Synthetic construct
cggatcccatgacaaggatt

SEQ ID NO: 1841 - DNA, 20 bp, Artificial Sequence
  Synthetic construct
ggatcccatgacaaggattt

SEQ ID NO: 1842 - DNA, 20 bp, Artificial Sequence
  Synthetic construct
gatcccatgacaaggatttg

SEQ ID NO: 1843 - DNA, 20 bp, Artificial Sequence
  Synthetic construct
atcccatgacaaggatttgt

SEQ ID NO: 1844 - DNA, 20 bp, Artificial Sequence
  Synthetic construct
tcccatgacaaggatttgtc

SEQ ID NO: 1845 - DNA, 20 bp, Artificial Sequence
  Synthetic construct
cccatgacaaggatttgtca

SEQ ID NO: 1846 - DNA, 20 bp, Artificial Sequence
  Synthetic construct
ccatgacaaggatttgtcat

SEQ ID NO: 1847 - DNA, 20 bp, Artificial Sequence
  Synthetic construct
catgacaaggatttgtcatg

SEQ ID NO: 1848 - DNA, 20 bp, Artificial Sequence
  Synthetic construct
atgacaaggatttgtcatgt

SEQ ID NO: 1849 - DNA, 20 bp, Artificial Sequence
  Synthetic construct
tgacaaggatttgtcatgta

SEQ ID NO: 1850 - DNA, 20 bp, Artificial Sequence
  Synthetic construct
gacaaggatttgtcatgtaa

SEQ ID NO: 1851 - DNA, 20 bp, Artificial Sequence
  Synthetic construct
acaaggatttgtcatgtaag

SEQ ID NO: 1852 - DNA, 20 bp, Artificial Sequence
  Synthetic construct
caaggatttgtcatgtaaga

SEQ ID NO: 1853 - DNA, 20 bp, Artificial Sequence
  Synthetic construct
aaggatttgtcatgtaagaa

SEQ ID NO: 1854 - DNA, 20 bp, Artificial Sequence
  Synthetic construct
aggatttgtcatgtaagaaa

SEQ ID NO: 1855 - DNA, 20 bp, Artificial Sequence
  Synthetic construct
ggatttgtcatgtaagaaac

SEQ ID NO: 1856 - DNA, 20 bp, Artificial Sequence
  Synthetic construct
gatttgtcatgtaagaaacc

SEQ ID NO: 1857 - DNA, 20 bp, Artificial Sequence
  Synthetic construct
atttgtcatgtaagaaacct

SEQ ID NO: 1858 - DNA, 20 bp, Artificial Sequence
  Synthetic construct
tttgtcatgtaagaaacctt

SEQ ID NO: 1859 - DNA, 20 bp, Artificial Sequence
  Synthetic construct
ttgtcatgtaagaaaccttc

SEQ ID NO: 1860 - DNA, 20 bp, Artificial Sequence
  Synthetic construct
tgtcatgtaagaaaccttct

SEQ ID NO: 1861 - DNA, 20 bp, Artificial Sequence
  Synthetic construct
gtcatgtaagaaaccttctc

SEQ ID NO: 1862 - DNA, 20 bp, Artificial Sequence
  Synthetic construct
tcatgtaagaaaccttctct

SEQ ID NO: 1863 - DNA, 20 bp, Artificial Sequence
  Synthetic construct
catgtaagaaaccttctcta

SEQ ID NO: 1864 - DNA, 20 bp, Artificial Sequence
  Synthetic construct
atgtaagaaaccttctctat

SEQ ID NO: 1865 - DNA, 20 bp, Artificial Sequence
  Synthetic construct
tgtaagaaaccttctctatt

SEQ ID NO: 1866 - DNA, 20 bp, Artificial Sequence
  Synthetic construct
gtaagaaaccttctctattt

SEQ ID NO: 1867 - DNA, 20 bp, Artificial Sequence
  Synthetic construct
taagaaaccttctctattta

SEQ ID NO: 1868 - DNA, 20 bp, Artificial Sequence
  Synthetic construct
aagaaaccttctctatttat

SEQ ID NO: 1869 - DNA, 20 bp, Artificial Sequence
  Synthetic construct
agaaaccttctctatttatc

SEQ ID NO: 1870 - DNA, 20 bp, Artificial Sequence
  Synthetic construct
gaaaccttctctatttatct

SEQ ID NO: 1871 - DNA, 20 bp, Artificial Sequence
  Synthetic construct
aaaccttctctatttatctg

SEQ ID NO: 1872 - DNA, 20 bp, Artificial Sequence
  Synthetic construct
aaccttctctatttatctga

SEQ ID NO: 1873 - DNA, 20 bp, Artificial Sequence
  Synthetic construct
accttctctatttatctgac

SEQ ID NO: 1874 - DNA, 20 bp, Artificial Sequence
  Synthetic construct
ccttctctatttatctgacc

SEQ ID NO: 1875 - DNA, 20 bp, Artificial Sequence
  Synthetic construct
cttctctatttatctgaccg

SEQ ID NO: 1876 - DNA, 20 bp, Artificial Sequence
  Synthetic construct
ttctctatttatctgaccgc

SEQ ID NO: 1877 - DNA, 20 bp, Artificial Sequence
  Synthetic construct
tctctatttatctgaccgcg

SEQ ID NO: 1878 - DNA, 20 bp, Artificial Sequence
  Synthetic construct
ctctatttatctgaccgcga

SEQ ID NO: 1879 - DNA, 20 bp, Artificial Sequence
  Synthetic construct
tctatttatctgaccgcgat

SEQ ID NO: 1880 - DNA, 20 bp, Artificial Sequence
  Synthetic construct
ctatttatctgaccgcgatc

SEQ ID NO: 1881 - DNA, 20 bp, Artificial Sequence
  Synthetic construct
tatttatctgaccgcgatca

SEQ ID NO: 1882 - DNA, 20 bp, Artificial Sequence
  Synthetic construct
atttatctgaccgcgatcac

SEQ ID NO: 1883 - DNA, 20 bp, Artificial Sequence
  Synthetic construct
tttatctgaccgcgatcacc

SEQ ID NO: 1884 - DNA, 20 bp, Artificial Sequence
  Synthetic construct
ttatctgaccgcgatcacca

SEQ ID NO: 1885 - DNA, 20 bp, Artificial Sequence
  Synthetic construct
tatctgaccgcgatcaccat

SEQ ID NO: 1886 - DNA, 20 bp, Artificial Sequence
  Synthetic construct
atctgaccgcgatcaccatt

SEQ ID NO: 1887 - DNA, 20 bp, Artificial Sequence
  Synthetic construct
tctgaccgcgatcaccattc

SEQ ID NO: 1888 - DNA, 20 bp, Artificial Sequence
  Synthetic construct
ctgaccgcgatcaccattcg

SEQ ID NO: 1889 - DNA, 20 bp, Artificial Sequence
  Synthetic construct
tgaccgcgatcaccattcgc

SEQ ID NO: 1890 - DNA, 20 bp, Artificial Sequence
  Synthetic construct
gaccgcgatcaccattcgcc

SEQ ID NO: 1891 - DNA, 20 bp, Artificial Sequence
  Synthetic construct
accgcgatcaccattcgcct

SEQ ID NO: 1892 - DNA, 20 bp, Artificial Sequence
  Synthetic construct
ccgcgatcaccattcgcctc

SEQ ID NO: 1893 - DNA, 20 bp, Artificial Sequence
  Synthetic construct
cgcgatcaccattcgcctcc

SEQ ID NO: 1894 - DNA, 20 bp, Artificial Sequence
  Synthetic construct
gcgatcaccattcgcctccc

SEQ ID NO: 1895 - DNA, 20 bp, Artificial Sequence
  Synthetic construct
cgatcaccattcgcctcccg

SEQ ID NO: 1896 - DNA, 20 bp, Artificial Sequence
  Synthetic construct
gatcaccattcgcctcccgt

SEQ ID NO: 1897 - DNA, 20 bp, Artificial Sequence
  Synthetic construct
atcaccattcgcctcccgta

SEQ ID NO: 1898 - DNA, 20 bp, Artificial Sequence
  Synthetic construct
tcaccattcgcctcccgtag

SEQ ID NO: 1899 - DNA, 20 bp, Artificial Sequence
  Synthetic construct
caccattcgcctcccgtagc

SEQ ID NO: 1900 - DNA, 20 bp, Artificial Sequence
  Synthetic construct
accattcgcctcccgtagct

SEQ ID NO: 1901 - DNA, 20 bp, Artificial Sequence
  Synthetic construct
ccattcgcctcccgtagctt

SEQ ID NO: 1902 - DNA, 20 bp, Artificial Sequence
  Synthetic construct
cattcgcctcccgtagctta

SEQ ID NO: 1903 - DNA, 20 bp, Artificial Sequence
  Synthetic construct
attcgcctcccgtagcttag

SEQ ID NO: 1904 - DNA, 20 bp, Artificial Sequence
  Synthetic construct
ttcgcctcccgtagcttagc

SEQ ID NO: 1905 - DNA, 20 bp, Artificial Sequence
  Synthetic construct
tcgcctcccgtagcttagcg

SEQ ID NO: 1906 - DNA, 20 bp, Artificial Sequence
  Synthetic construct
cgcctcccgtagcttagcga

SEQ ID NO: 1907 - DNA, 20 bp, Artificial Sequence
  Synthetic construct
gcctcccgtagcttagcgat

SEQ ID NO: 1908 - DNA, 20 bp, Artificial Sequence
  Synthetic construct
cctcccgtagcttagcgata

SEQ ID NO: 1909 - DNA, 20 bp, Artificial Sequence
  Synthetic construct
ctcccgtagcttagcgatag

SEQ ID NO: 1910 - DNA, 20 bp, Artificial Sequence
  Synthetic construct
tcccgtagcttagcgatagc

SEQ ID NO: 1911 - DNA, 20 bp, Artificial Sequence
  Synthetic construct
cccgtagcttagcgatagct

SEQ ID NO: 1912 - DNA, 20 bp, Artificial Sequence
  Synthetic construct
ccgtagcttagcgatagcta

SEQ ID NO: 1913 - DNA, 20 bp, Artificial Sequence
  Synthetic construct
cgtagcttagcgatagctaa

SEQ ID NO: 1914 - DNA, 20 bp, Artificial Sequence
  Synthetic construct
gtagcttagcgatagctaag

SEQ ID NO: 1915 - DNA, 20 bp, Artificial Sequence
  Synthetic construct
tagcttagcgatagctaagg

SEQ ID NO: 1916 - DNA, 20 bp, Artificial Sequence
  Synthetic construct
agcttagcgatagctaaggt

SEQ ID NO: 1917 - DNA, 20 bp, Artificial Sequence
  Synthetic construct
gcttagcgatagctaaggta

SEQ ID NO: 1918 - DNA, 20 bp, Artificial Sequence
  Synthetic construct
cttagcgatagctaaggtac

SEQ ID NO: 1919 - DNA, 20 bp, Artificial Sequence
  Synthetic construct
ttagcgatagctaaggtacg

SEQ ID NO: 1920 - DNA, 20 bp, Artificial Sequence
  Synthetic construct
tagcgatagctaaggtacga

SEQ ID NO: 1921 - DNA, 20 bp, Artificial Sequence
  Synthetic construct
agcgatagctaaggtacgac

SEQ ID NO: 1922 - DNA, 20 bp, Artificial Sequence
  Synthetic construct
gcgatagctaaggtacgacg

SEQ ID NO: 1923 - DNA, 20 bp, Artificial Sequence
  Synthetic construct
cgatagctaaggtacgacgg

SEQ ID NO: 1924 - DNA, 20 bp, Artificial Sequence
  Synthetic construct
gatagctaaggtacgacggg

SEQ ID NO: 1925 - DNA, 20 bp, Artificial Sequence
  Synthetic construct
atagctaaggtacgacgggt

SEQ ID NO: 1926 - DNA, 20 bp, Artificial Sequence
  Synthetic construct
tagctaaggtacgacgggtc

SEQ ID NO: 1927 - DNA, 20 bp, Artificial Sequence
  Synthetic construct
agctaaggtacgacgggtcg

SEQ ID NO: 1928 - DNA, 20 bp, Artificial Sequence
  Synthetic construct
gctaaggtacgacgggtcgc

SEQ ID NO: 1929 - DNA, 20 bp, Artificial Sequence
  Synthetic construct
ctaaggtacgacgggtcgcc

SEQ ID NO: 1930 - DNA, 20 bp, Artificial Sequence
  Synthetic construct
taaggtacgacgggtcgcct

SEQ ID NO: 1931 - DNA, 20 bp, Artificial Sequence
  Synthetic construct
aaggtacgacgggtcgcctc

SEQ ID NO: 1932 - DNA, 20 bp, Artificial Sequence
  Synthetic construct
aggtacgacgggtcgcctcg

SEQ ID NO: 1933 - DNA, 20 bp, Artificial Sequence
  Synthetic construct
ggtacgacgggtcgcctcgt

SEQ ID NO: 1934 - DNA, 20 bp, Artificial Sequence
  Synthetic construct
gtacgacgggtcgcctcgtc

SEQ ID NO: 1935 - DNA, 20 bp, Artificial Sequence
  Synthetic construct
tacgacgggtcgcctcgtca

SEQ ID NO: 1936 - DNA, 20 bp, Artificial Sequence
  Synthetic construct
acgacgggtcgcctcgtcat

SEQ ID NO: 1937 - DNA, 20 bp, Artificial Sequence
  Synthetic construct
cgacgggtcgcctcgtcatt

SEQ ID NO: 1938 - DNA, 20 bp, Artificial Sequence
  Synthetic construct
gacgggtcgcctcgtcatta

SEQ ID NO: 1939 - DNA, 20 bp, Artificial Sequence
  Synthetic construct
acgggtcgcctcgtcattac

SEQ ID NO: 1940 - DNA, 20 bp, Artificial Sequence
  Synthetic construct
cgggtcgcctcgtcattacc

SEQ ID NO: 1941 - DNA, 20 bp, Artificial Sequence
  Synthetic construct
gggtcgcctcgtcattacca

SEQ ID NO: 1942 - DNA, 20 bp, Artificial Sequence
  Synthetic construct
ggtcgcctcgtcattaccag

SEQ ID NO: 1943 - DNA, 20 bp, Artificial Sequence
  Synthetic construct
gtcgcctcgtcattaccaga

SEQ ID NO: 1944 - DNA, 20 bp, Artificial Sequence
  Synthetic construct
tcgcctcgtcattaccagaa

SEQ ID NO: 1945 - DNA, 20 bp, Artificial Sequence
  Synthetic construct
cgcctcgtcattaccagaac

SEQ ID NO: 1946 - DNA, 20 bp, Artificial Sequence
  Synthetic construct
gcctcgtcattaccagaacc

SEQ ID NO: 1947 - DNA, 20 bp, Artificial Sequence
  Synthetic construct
cctcgtcattaccagaacct

SEQ ID NO: 1948 - DNA, 20 bp, Artificial Sequence
  Synthetic construct
ctcgtcattaccagaaccta

SEQ ID NO: 1949 - DNA, 20 bp, Artificial Sequence
  Synthetic construct
tcgtcattaccagaacctaa

SEQ ID NO: 1950 - DNA, 20 bp, Artificial Sequence
  Synthetic construct
cgtcattaccagaacctaag

SEQ ID NO: 1951 - DNA, 20 bp, Artificial Sequence
  Synthetic construct
gtcattaccagaacctaagg

SEQ ID NO: 1952 - DNA, 20 bp, Artificial Sequence
  Synthetic construct
tcattaccagaacctaaggt

SEQ ID NO: 1953 - DNA, 20 bp, Artificial Sequence
  Synthetic construct
cattaccagaacctaaggtc

SEQ ID NO: 1954 - DNA, 20 bp, Artificial Sequence
  Synthetic construct
attaccagaacctaaggtcg

SEQ ID NO: 1955 - DNA, 20 bp, Artificial Sequence
  Synthetic construct
ttaccagaacctaaggtcgg

SEQ ID NO: 1956 - DNA, 20 bp, Artificial Sequence
  Synthetic construct
taccagaacctaaggtcgga

SEQ ID NO: 1957 - DNA, 20 bp, Artificial Sequence
  Synthetic construct
accagaacctaaggtcggat

SEQ ID NO: 1958 - DNA, 20 bp, Artificial Sequence
  Synthetic construct
ccagaacctaaggtcggatg

SEQ ID NO: 1959 - DNA, 20 bp, Artificial Sequence
  Synthetic construct
cagaacctaaggtcggatgc

SEQ ID NO: 1960 - DNA, 20 bp, Artificial Sequence
  Synthetic construct
agaacctaaggtcggatgct

SEQ ID NO: 1961 - DNA, 20 bp, Artificial Sequence
  Synthetic construct
gaacctaaggtcggatgctt

SEQ ID NO: 1962 - DNA, 20 bp, Artificial Sequence
  Synthetic construct
aacctaaggtcggatgcttt

SEQ ID NO: 1963 - DNA, 20 bp, Artificial Sequence
  Synthetic construct
acctaaggtcggatgctttg

SEQ ID NO: 1964 - DNA, 20 bp, Artificial Sequence
  Synthetic construct
cctaaggtcggatgctttgt

SEQ ID NO: 1965 - DNA, 20 bp, Artificial Sequence
  Synthetic construct
ctaaggtcggatgctttgtg

SEQ ID NO: 1966 - DNA, 20 bp, Artificial Sequence
  Synthetic construct
taaggtcggatgctttgtga

SEQ ID NO: 1967 - DNA, 20 bp, Artificial Sequence
  Synthetic construct
aaggtcggatgctttgtgag

SEQ ID NO: 1968 - DNA, 20 bp, Artificial Sequence
  Synthetic construct
aggtcggatgctttgtgagc

SEQ ID NO: 1969 - DNA, 20 bp, Artificial Sequence
  Synthetic construct
ggtcggatgctttgtgagca

SEQ ID NO: 1970 - DNA, 20 bp, Artificial Sequence
  Synthetic construct
gtcggatgctttgtgagcaa

SEQ ID NO: 1971 - DNA, 20 bp, Artificial Sequence
  Synthetic construct
tcggatgctttgtgagcaat

SEQ ID NO: 1972 - DNA, 20 bp, Artificial Sequence
  Synthetic construct
cggatgctttgtgagcaatt

SEQ ID NO: 1973 - DNA, 20 bp, Artificial Sequence
  Synthetic construct
ggatgctttgtgagcaattc

SEQ ID NO: 1974 - DNA, 20 bp, Artificial Sequence
  Synthetic construct
gatgctttgtgagcaattcg

SEQ ID NO: 1975 - DNA, 20 bp, Artificial Sequence
  Synthetic construct
atgctttgtgagcaattcgt

SEQ ID NO: 1976 - DNA, 20 bp, Artificial Sequence
  Synthetic construct
tgctttgtgagcaattcgtc

SEQ ID NO: 1977 - DNA, 20 bp, Artificial Sequence
  Synthetic construct
gctttgtgagcaattcgtcc

SEQ ID NO: 1978 - DNA, 20 bp, Artificial Sequence
  Synthetic construct
ctttgtgagcaattcgtccc

SEQ ID NO: 1979 - DNA, 20 bp, Artificial Sequence
  Synthetic construct
tttgtgagcaattcgtccct

SEQ ID NO: 1980 - DNA, 20 bp, Artificial Sequence
  Synthetic construct
ttgtgagcaattcgtccctt

SEQ ID NO: 1981 - DNA, 20 bp, Artificial Sequence
  Synthetic construct
tgtgagcaattcgtccctta

SEQ ID NO: 1982 - DNA, 20 bp, Artificial Sequence
  Synthetic construct
gtgagcaattcgtcccttaa

SEQ ID NO: 1983 - DNA, 20 bp, Artificial Sequence
  Synthetic construct
tgagcaattcgtcccttaag

SEQ ID NO: 1984 - DNA, 20 bp, Artificial Sequence
  Synthetic construct
gagcaattcgtcccttaagt

SEQ ID NO: 1985 - DNA, 20 bp, Artificial Sequence
  Synthetic construct
agcaattcgtcccttaagta

SEQ ID NO: 1986 - DNA, 20 bp, Artificial Sequence
  Synthetic construct
gcaattcgtcccttaagtaa

SEQ ID NO: 1987 - DNA, 20 bp, Artificial Sequence
  Synthetic construct
caattcgtcccttaagtaag

SEQ ID NO: 1988 - DNA, 20 bp, Artificial Sequence
  Synthetic construct
aattcgtcccttaagtaagc

SEQ ID NO: 1989 - DNA, 20 bp, Artificial Sequence
  Synthetic construct
attcgtcccttaagtaagca

SEQ ID NO: 1990 - DNA, 20 bp, Artificial Sequence
  Synthetic construct
ttcgtcccttaagtaagcaa

SEQ ID NO: 1991 - DNA, 20 bp, Artificial Sequence
  Synthetic construct
tcgtcccttaagtaagcaat

SEQ ID NO: 1992 - DNA, 20 bp, Artificial Sequence
  Synthetic construct
cgtcccttaagtaagcaatt

SEQ ID NO: 1993 - DNA, 20 bp, Artificial Sequence
  Synthetic construct
gtcccttaagtaagcaattg

SEQ ID NO: 1994 - DNA, 20 bp, Artificial Sequence
  Synthetic construct
tcccttaagtaagcaattgc

SEQ ID NO: 1995 - DNA, 20 bp, Artificial Sequence
  Synthetic construct
cccttaagtaagcaattgct

SEQ ID NO: 1996 - DNA, 20 bp, Artificial Sequence
  Synthetic construct
ccttaagtaagcaattgctg

SEQ ID NO: 1997 - DNA, 20 bp, Artificial Sequence
  Synthetic construct
cttaagtaagcaattgctgt

SEQ ID NO: 1998 - DNA, 20 bp, Artificial Sequence
  Synthetic construct
ttaagtaagcaattgctgta

SEQ ID NO: 1999 - DNA, 20 bp, Artificial Sequence
  Synthetic construct
taagtaagcaattgctgtaa

SEQ ID NO: 2000 - DNA, 20 bp, Artificial Sequence
  Synthetic construct
aagtaagcaattgctgtaaa

SEQ ID NO: 2001 - DNA, 20 bp, Artificial Sequence
  Synthetic construct
agtaagcaattgctgtaaag

SEQ ID NO: 2002 - DNA, 20 bp, Artificial Sequence
  Synthetic construct
gtaagcaattgctgtaaagt

SEQ ID NO: 2003 - DNA, 20 bp, Artificial Sequence
  Synthetic construct
taagcaattgctgtaaagtc

SEQ ID NO: 2004 - DNA, 20 bp, Artificial Sequence
  Synthetic construct
aagcaattgctgtaaagtcg

SEQ ID NO: 2005 - DNA, 20 bp, Artificial Sequence
  Synthetic construct
agcaattgctgtaaagtcgt

SEQ ID NO: 2006 - DNA, 20 bp, Artificial Sequence
  Synthetic construct
gcaattgctgtaaagtcgtc

SEQ ID NO: 2007 - DNA, 20 bp, Artificial Sequence
  Synthetic construct
caattgctgtaaagtcgtca

SEQ ID NO: 2008 - DNA, 20 bp, Artificial Sequence
  Synthetic construct
aattgctgtaaagtcgtcac

SEQ ID NO: 2009 - DNA, 20 bp, Artificial Sequence
  Synthetic construct
attgctgtaaagtcgtcact

SEQ ID NO: 2010 - DNA, 20 bp, Artificial Sequence
  Synthetic construct
ttgctgtaaagtcgtcactg

SEQ ID NO: 2011 - DNA, 20 bp, Artificial Sequence
  Synthetic construct
tgctgtaaagtcgtcactgt

SEQ ID NO: 2012 - DNA, 20 bp, Artificial Sequence
  Synthetic construct
gctgtaaagtcgtcactgtg

SEQ ID NO: 2013 - DNA, 20 bp, Artificial Sequence
  Synthetic construct
ctgtaaagtcgtcactgtgc

SEQ ID NO: 2014 - DNA, 20 bp, Artificial Sequence
  Synthetic construct
tgtaaagtcgtcactgtgcg

SEQ ID NO: 2015 - DNA, 20 bp, Artificial Sequence
  Synthetic construct
gtaaagtcgtcactgtgcgg

SEQ ID NO: 2016 - DNA, 20 bp, Artificial Sequence
  Synthetic construct
taaagtcgtcactgtgcgga

SEQ ID NO: 2017 - DNA, 20 bp, Artificial Sequence
  Synthetic construct
aaagtcgtcactgtgcggat

SEQ ID NO: 2018 - DNA, 20 bp, Artificial Sequence
  Synthetic construct
aagtcgtcactgtgcggatc

SEQ ID NO: 2019 - DNA, 20 bp, Artificial Sequence
  Synthetic construct
agtcgtcactgtgcggatca

SEQ ID NO: 2020 - DNA, 20 bp, Artificial Sequence
  Synthetic construct
gtcgtcactgtgcggatcac

SEQ ID NO: 2021 - DNA, 20 bp, Artificial Sequence
  Synthetic construct
tcgtcactgtgcggatcacc

SEQ ID NO: 2022 - DNA, 20 bp, Artificial Sequence
  Synthetic construct
cgtcactgtgcggatcaccg

SEQ ID NO: 2023 - DNA, 20 bp, Artificial Sequence
  Synthetic construct
gtcactgtgcggatcaccgc

SEQ ID NO: 2024 - DNA, 20 bp, Artificial Sequence
  Synthetic construct
tcactgtgcggatcaccgct

SEQ ID NO: 2025 - DNA, 20 bp, Artificial Sequence
  Synthetic construct
cactgtgcggatcaccgctt

SEQ ID NO: 2026 - DNA, 20 bp, Artificial Sequence
  Synthetic construct
actgtgcggatcaccgcttc

SEQ ID NO: 2027 - DNA, 20 bp, Artificial Sequence
  Synthetic construct
ctgtgcggatcaccgcttcc

SEQ ID NO: 2028 - DNA, 20 bp, Artificial Sequence
  Synthetic construct
tgtgcggatcaccgcttcca

SEQ ID NO: 2029 - DNA, 20 bp, Artificial Sequence
  Synthetic construct
gtgcggatcaccgcttccag

SEQ ID NO: 2030 - DNA, 20 bp, Artificial Sequence
  Synthetic construct
tgcggatcaccgcttccagt

SEQ ID NO: 2031 - DNA, 20 bp, Artificial Sequence
  Synthetic construct
gcggatcaccgcttccagta

SEQ ID NO: 2032 - DNA, 20 bp, Artificial Sequence
  Synthetic construct
cggatcaccgcttccagtag

SEQ ID NO: 2033 - DNA, 20 bp, Artificial Sequence
  Synthetic construct
ggatcaccgcttccagtagc

SEQ ID NO: 2034 - DNA, 20 bp, Artificial Sequence
  Synthetic construct
gatcaccgcttccagtagcg

SEQ ID NO: 2035 - DNA, 20 bp, Artificial Sequence
  Synthetic construct
atcaccgcttccagtagcga

SEQ ID NO: 2036 - DNA, 20 bp, Artificial Sequence
  Synthetic construct
tcaccgcttccagtagcgac

SEQ ID NO: 2037 - DNA, 20 bp, Artificial Sequence
  Synthetic construct
caccgcttccagtagcgaca

SEQ ID NO: 2038 - DNA, 20 bp, Artificial Sequence
  Synthetic construct
accgcttccagtagcgacag

SEQ ID NO: 2039 - DNA, 20 bp, Artificial Sequence
  Synthetic construct
ccgcttccagtagcgacaga

SEQ ID NO: 2040 - DNA, 20 bp, Artificial Sequence
  Synthetic construct
cgcttccagtagcgacagaa

SEQ ID NO: 2041 - DNA, 20 bp, Artificial Sequence
  Synthetic construct
gcttccagtagcgacagaag

SEQ ID NO: 2042 - DNA, 20 bp, Artificial Sequence
  Synthetic construct
cttccagtagcgacagaagc

SEQ ID NO: 2043 - DNA, 20 bp, Artificial Sequence
  Synthetic construct
ttccagtagcgacagaagca

SEQ ID NO: 2044 - DNA, 20 bp, Artificial Sequence
  Synthetic construct
tccagtagcgacagaagcaa

SEQ ID NO: 2045 - DNA, 20 bp, Artificial Sequence
  Synthetic construct
ccagtagcgacagaagcaat

SEQ ID NO: 2046 - DNA, 20 bp, Artificial Sequence
  Synthetic construct
cagtagcgacagaagcaatt

SEQ ID NO: 2047 - DNA, 20 bp, Artificial Sequence
  Synthetic construct
agtagcgacagaagcaattg

SEQ ID NO: 2048 - DNA, 20 bp, Artificial Sequence
  Synthetic construct
gtagcgacagaagcaattga

SEQ ID NO: 2049 - DNA, 20 bp, Artificial Sequence
  Synthetic construct
tagcgacagaagcaattgat

SEQ ID NO: 2050 - DNA, 20 bp, Artificial Sequence
  Synthetic construct
agcgacagaagcaattgatt

SEQ ID NO: 2051 - DNA, 20 bp, Artificial Sequence
  Synthetic construct
gcgacagaagcaattgattg

SEQ ID NO: 2052 - DNA, 20 bp, Artificial Sequence
  Synthetic construct
cgacagaagcaattgattgg

SEQ ID NO: 2053 - DNA, 20 bp, Artificial Sequence
  Synthetic construct
gacagaagcaattgattggt

SEQ ID NO: 2054 - DNA, 20 bp, Artificial Sequence
  Synthetic construct
acagaagcaattgattggta

SEQ ID NO: 2055 - DNA, 20 bp, Artificial Sequence
  Synthetic construct
cagaagcaattgattggtaa

SEQ ID NO: 2056 - DNA, 20 bp, Artificial Sequence
  Synthetic construct
agaagcaattgattggtaaa

SEQ ID NO: 2057 - DNA, 20 bp, Artificial Sequence
  Synthetic construct
gaagcaattgattggtaaat

SEQ ID NO: 2058 - DNA, 20 bp, Artificial Sequence
  Synthetic construct
aagcaattgattggtaaatt

SEQ ID NO: 2059 - DNA, 20 bp, Artificial Sequence
  Synthetic construct
agcaattgattggtaaattt

SEQ ID NO: 2060 - DNA, 20 bp, Artificial Sequence
  Synthetic construct
gcaattgattggtaaatttc

SEQ ID NO: 2061 - DNA, 20 bp, Artificial Sequence
  Synthetic construct
caattgattggtaaatttcg

SEQ ID NO: 2062 - DNA, 20 bp, Artificial Sequence
  Synthetic construct
aattgattggtaaatttcga

SEQ ID NO: 2063 - DNA, 20 bp, Artificial Sequence
  Synthetic construct
attgattggtaaatttcgag

SEQ ID NO: 2064 - DNA, 20 bp, Artificial Sequence
  Synthetic construct
ttgattggtaaatttcgaga

SEQ ID NO: 2065 - DNA, 20 bp, Artificial Sequence
  Synthetic construct
tgattggtaaatttcgagag

SEQ ID NO: 2066 - DNA, 20 bp, Artificial Sequence
  Synthetic construct
gattggtaaatttcgagaga

SEQ ID NO: 2067 - DNA, 20 bp, Artificial Sequence
  Synthetic construct
attggtaaatttcgagagaa

SEQ ID NO: 2068 - DNA, 20 bp, Artificial Sequence
  Synthetic construct
ttggtaaatttcgagagaaa

SEQ ID NO: 2069 - DNA, 20 bp, Artificial Sequence
  Synthetic construct
tggtaaatttcgagagaaag

SEQ ID NO: 2070 - DNA, 20 bp, Artificial Sequence
  Synthetic construct
ggtaaatttcgagagaaaga

SEQ ID NO: 2071 - DNA, 20 bp, Artificial Sequence
  Synthetic construct
gtaaatttcgagagaaagat

SEQ ID NO: 2072 - DNA, 20 bp, Artificial Sequence
  Synthetic construct
taaatttcgagagaaagatc

SEQ ID NO: 2073 - DNA, 20 bp, Artificial Sequence
  Synthetic construct
aaatttcgagagaaagatcg

SEQ ID NO: 2074 - DNA, 20 bp, Artificial Sequence
  Synthetic construct
aatttcgagagaaagatcgc

SEQ ID NO: 2075 - DNA, 20 bp, Artificial Sequence
  Synthetic construct
atttcgagagaaagatcgcg

SEQ ID NO: 2076 - DNA, 20 bp, Artificial Sequence
  Synthetic construct
tttcgagagaaagatcgcga

SEQ ID NO: 2077 - DNA, 20 bp, Artificial Sequence
  Synthetic construct
ttcgagagaaagatcgcgag

SEQ ID NO: 2078 - DNA, 20 bp, Artificial Sequence
  Synthetic construct
tcgagagaaagatcgcgagg

SEQ ID NO: 2079 - DNA, 20 bp, Artificial Sequence
  Synthetic construct
cgagagaaagatcgcgagga

SEQ ID NO: 2080 - DNA, 20 bp, Artificial Sequence
  Synthetic construct
gagagaaagatcgcgaggaa

SEQ ID NO: 2081 - DNA, 20 bp, Artificial Sequence
  Synthetic construct
agagaaagatcgcgaggaag

SEQ ID NO: 2082 - DNA, 20 bp, Artificial Sequence
  Synthetic construct
gagaaagatcgcgaggaaga

SEQ ID NO: 2083 - DNA, 20 bp, Artificial Sequence
  Synthetic construct
agaaagatcgcgaggaagat

SEQ ID NO: 2084 - DNA, 20 bp, Artificial Sequence
  Synthetic construct
gaaagatcgcgaggaagatc

SEQ ID NO: 2085 - DNA, 20 bp, Artificial Sequence
  Synthetic construct
aaagatcgcgaggaagatca

SEQ ID NO: 2086 - DNA, 20 bp, Artificial Sequence
  Synthetic construct
aagatcgcgaggaagatcaa

SEQ ID NO: 2087 - DNA, 20 bp, Artificial Sequence
  Synthetic construct
agatcgcgaggaagatcaat

SEQ ID NO: 2088 - DNA, 20 bp, Artificial Sequence
  Synthetic construct
gatcgcgaggaagatcaata

SEQ ID NO: 2089 - DNA, 20 bp, Artificial Sequence
  Synthetic construct
atcgcgaggaagatcaatac

SEQ ID NO: 2090 - DNA, 20 bp, Artificial Sequence
  Synthetic construct
tcgcgaggaagatcaataca

SEQ ID NO: 2091 - DNA, 20 bp, Artificial Sequence
  Synthetic construct
cgcgaggaagatcaatacat

SEQ ID NO: 2092 - DNA, 20 bp, Artificial Sequence
  Synthetic construct
gcgaggaagatcaatacata

SEQ ID NO: 2093 - DNA, 20 bp, Artificial Sequence
  Synthetic construct
cgaggaagatcaatacataa

SEQ ID NO: 2094 - DNA, 20 bp, Artificial Sequence
  Synthetic construct
gaggaagatcaatacataaa

SEQ ID NO: 2095 - DNA, 20 bp, Artificial Sequence
  Synthetic construct
aggaagatcaatacataaag

SEQ ID NO: 2096 - DNA, 20 bp, Artificial Sequence
  Synthetic construct
ggaagatcaatacataaaga

SEQ ID NO: 2097 - DNA, 20 bp, Artificial Sequence
  Synthetic construct
gaagatcaatacataaagag

SEQ ID NO: 2098 - DNA, 20 bp, Artificial Sequence
  Synthetic construct
aagatcaatacataaagagt

SEQ ID NO: 2099 - DNA, 20 bp, Artificial Sequence
  Synthetic construct
agatcaatacataaagagtt

SEQ ID NO: 2100 - DNA, 20 bp, Artificial Sequence
  Synthetic construct
gatcaatacataaagagttg

SEQ ID NO: 2101 - DNA, 20 bp, Artificial Sequence
  Synthetic construct
atcaatacataaagagttga

SEQ ID NO: 2102 - DNA, 20 bp, Artificial Sequence
  Synthetic construct
tcaatacataaagagttgaa

SEQ ID NO: 2103 - DNA, 20 bp, Artificial Sequence
  Synthetic construct
caatacataaagagttgaac

SEQ ID NO: 2104 - DNA, 20 bp, Artificial Sequence
  Synthetic construct
aatacataaagagttgaact

SEQ ID NO: 2105 - DNA, 20 bp, Artificial Sequence
  Synthetic construct
atacataaagagttgaactt

SEQ ID NO: 2106 - DNA, 20 bp, Artificial Sequence
  Synthetic construct
tacataaagagttgaacttc

SEQ ID NO: 2107 - DNA, 20 bp, Artificial Sequence
  Synthetic construct
acataaagagttgaacttct

SEQ ID NO: 2108 - DNA, 20 bp, Artificial Sequence
  Synthetic construct
cataaagagttgaacttctt

SEQ ID NO: 2109 - DNA, 20 bp, Artificial Sequence
  Synthetic construct
ataaagagttgaacttcttt

SEQ ID NO: 2110 - DNA, 20 bp, Artificial Sequence
  Synthetic construct
taaagagttgaacttctttg

SEQ ID NO: 2111 - DNA, 20 bp, Artificial Sequence
  Synthetic construct
aaagagttgaacttctttgt

SEQ ID NO: 2112 - DNA, 20 bp, Artificial Sequence
  Synthetic construct
aagagttgaacttctttgtt

SEQ ID NO: 2113 - DNA, 20 bp, Artificial Sequence
  Synthetic construct
agagttgaacttctttgttg

SEQ ID NO: 2114 - DNA, 20 bp, Artificial Sequence
  Synthetic construct
gagttgaacttctttgttgt

SEQ ID NO: 2115 - DNA, 20 bp, Artificial Sequence
  Synthetic construct
agttgaacttctttgttgtc

SEQ ID NO: 2116 - DNA, 20 bp, Artificial Sequence
  Synthetic construct
gttgaacttctttgttgtct

SEQ ID NO: 2117 - DNA, 20 bp, Artificial Sequence
  Synthetic construct
ttgaacttctttgttgtctt

SEQ ID NO: 2118 - DNA, 20 bp, Artificial Sequence
  Synthetic construct
tgaacttctttgttgtcttc

SEQ ID NO: 2119 - DNA, 20 bp, Artificial Sequence
  Synthetic construct
gaacttctttgttgtcttcg

SEQ ID NO: 2120 - DNA, 20 bp, Artificial Sequence
  Synthetic construct
aacttctttgttgtcttcga

SEQ ID NO: 2121 - DNA, 20 bp, Artificial Sequence
  Synthetic construct
acttctttgttgtcttcgac

SEQ ID NO: 2122 - DNA, 20 bp, Artificial Sequence
  Synthetic construct
cttctttgttgtcttcgaca

SEQ ID NO: 2123 - DNA, 20 bp, Artificial Sequence
  Synthetic construct
ttctttgttgtcttcgacat

SEQ ID NO: 2124 - DNA, 20 bp, Artificial Sequence
  Synthetic construct
tctttgttgtcttcgacatg

SEQ ID NO: 2125 - DNA, 20 bp, Artificial Sequence
  Synthetic construct
ctttgttgtcttcgacatgg

SEQ ID NO: 2126 - DNA, 20 bp, Artificial Sequence
  Synthetic construct
tttgttgtcttcgacatggg

SEQ ID NO: 2127 - DNA, 20 bp, Artificial Sequence
  Synthetic construct
ttgttgtcttcgacatgggt

SEQ ID NO: 2128 - DNA, 20 bp, Artificial Sequence
  Synthetic construct
tgttgtcttcgacatgggta

SEQ ID NO: 2129 - DNA, 20 bp, Artificial Sequence
  Synthetic construct
gttgtcttcgacatgggtaa

SEQ ID NO: 2130 - DNA, 20 bp, Artificial Sequence
  Synthetic construct
ttgtcttcgacatgggtaat

SEQ ID NO: 2131 - DNA, 20 bp, Artificial Sequence
  Synthetic construct
tgtcttcgacatgggtaatc

SEQ ID NO: 2132 - DNA, 20 bp, Artificial Sequence
  Synthetic construct
gtcttcgacatgggtaatcc

SEQ ID NO: 2133 - DNA, 20 bp, Artificial Sequence
  Synthetic construct
tcttcgacatgggtaatcct

SEQ ID NO: 2134 - DNA, 20 bp, Artificial Sequence
  Synthetic construct
cttcgacatgggtaatcctc

SEQ ID NO: 2135 - DNA, 20 bp, Artificial Sequence
  Synthetic construct
ttcgacatgggtaatcctca

SEQ ID NO: 2136 - DNA, 20 bp, Artificial Sequence
  Synthetic construct
tcgacatgggtaatcctcat

SEQ ID NO: 2137 - DNA, 20 bp, Artificial Sequence
  Synthetic construct
cgacatgggtaatcctcatg

SEQ ID NO: 2138 - DNA, 20 bp, Artificial Sequence
  Synthetic construct
gacatgggtaatcctcatgt

SEQ ID NO: 2139 - DNA, 20 bp, Artificial Sequence
  Synthetic construct
acatgggtaatcctcatgtt

SEQ ID NO: 2140 - DNA, 20 bp, Artificial Sequence
  Synthetic construct
catgggtaatcctcatgttt

SEQ ID NO: 2141 - DNA, 20 bp, Artificial Sequence
  Synthetic construct
atgggtaatcctcatgtttg

SEQ ID NO: 2142 - DNA, 20 bp, Artificial Sequence
  Synthetic construct
tgggtaatcctcatgtttga

SEQ ID NO: 2143 - DNA, 20 bp, Artificial Sequence
  Synthetic construct
gggtaatcctcatgtttgaa

SEQ ID NO: 2144 - DNA, 20 bp, Artificial Sequence
  Synthetic construct
ggtaatcctcatgtttgaat

SEQ ID NO: 2145 - DNA, 20 bp, Artificial Sequence
  Synthetic construct
gtaatcctcatgtttgaatg

SEQ ID NO: 2146 - DNA, 20 bp, Artificial Sequence
  Synthetic construct
taatcctcatgtttgaatgg

SEQ ID NO: 2147 - DNA, 20 bp, Artificial Sequence
  Synthetic construct
aatcctcatgtttgaatggc

SEQ ID NO: 2148 - DNA, 20 bp, Artificial Sequence
  Synthetic construct
atcctcatgtttgaatggcc

SEQ ID NO: 2149 - DNA, 20 bp, Artificial Sequence
  Synthetic construct
tcctcatgtttgaatggccg

SEQ ID NO: 2150 - DNA, 20 bp, Artificial Sequence
  Synthetic construct
cctcatgtttgaatggccgg

SEQ ID NO: 2151 - DNA, 20 bp, Artificial Sequence
  Synthetic construct
ctcatgtttgaatggccggc

SEQ ID NO: 2152 - DNA, 20 bp, Artificial Sequence
  Synthetic construct
tcatgtttgaatggccggcg

SEQ ID NO: 2153 - DNA, 20 bp, Artificial Sequence
  Synthetic construct
catgtttgaatggccggcgt

SEQ ID NO: 2154 - DNA, 20 bp, Artificial Sequence
  Synthetic construct
atgtttgaatggccggcgtc

SEQ ID NO: 2155 - DNA, 20 bp, Artificial Sequence
  Synthetic construct
tgtttgaatggccggcgtct

SEQ ID NO: 2156 - DNA, 20 bp, Artificial Sequence
  Synthetic construct
gtttgaatggccggcgtcta

SEQ ID NO: 2157 - DNA, 20 bp, Artificial Sequence
  Synthetic construct
tttgaatggccggcgtctat

SEQ ID NO: 2158 - DNA, 20 bp, Artificial Sequence
  Synthetic construct
ttgaatggccggcgtctatt

SEQ ID NO: 2159 - DNA, 20 bp, Artificial Sequence
  Synthetic construct
tgaatggccggcgtctatta

SEQ ID NO: 2160 - DNA, 20 bp, Artificial Sequence
  Synthetic construct
gaatggccggcgtctattag

SEQ ID NO: 2161 - DNA, 20 bp, Artificial Sequence
  Synthetic construct
aatggccggcgtctattagt

SEQ ID NO: 2162 - DNA, 20 bp, Artificial Sequence
  Synthetic construct
atggccggcgtctattagta

SEQ ID NO: 2163 - DNA, 20 bp, Artificial Sequence
  Synthetic construct
tggccggcgtctattagtag

SEQ ID NO: 2164 - DNA, 20 bp, Artificial Sequence
  Synthetic construct
ggccggcgtctattagtaga

SEQ ID NO: 2165 - DNA, 20 bp, Artificial Sequence
  Synthetic construct
gccggcgtctattagtagat

SEQ ID NO: 2166 - DNA, 20 bp, Artificial Sequence
  Synthetic construct
ccggcgtctattagtagatg

SEQ ID NO: 2167 - DNA, 20 bp, Artificial Sequence
  Synthetic construct
cggcgtctattagtagatgc

SEQ ID NO: 2168 - DNA, 20 bp, Artificial Sequence
  Synthetic construct
ggcgtctattagtagatgcc

SEQ ID NO: 2169 - DNA, 20 bp, Artificial Sequence
  Synthetic construct
gcgtctattagtagatgccg

SEQ ID NO: 2170 - DNA, 20 bp, Artificial Sequence
  Synthetic construct
cgtctattagtagatgccgg

SEQ ID NO: 2171 - DNA, 20 bp, Artificial Sequence
  Synthetic construct
gtctattagtagatgccgga

SEQ ID NO: 2172 - DNA, 20 bp, Artificial Sequence
  Synthetic construct
tctattagtagatgccggag

SEQ ID NO: 2173 - DNA, 20 bp, Artificial Sequence
  Synthetic construct
ctattagtagatgccggagt

SEQ ID NO: 2174 - DNA, 20 bp, Artificial Sequence
  Synthetic construct
tattagtagatgccggagtt

SEQ ID NO: 2175 - DNA, 20 bp, Artificial Sequence
  Synthetic construct
attagtagatgccggagttt

SEQ ID NO: 2176 - DNA, 20 bp, Artificial Sequence
  Synthetic construct
ttagtagatgccggagtttg

SEQ ID NO: 2177 - DNA, 20 bp, Artificial Sequence
  Synthetic construct
tagtagatgccggagtttgc

SEQ ID NO: 2178 - DNA, 20 bp, Artificial Sequence
  Synthetic construct
agtagatgccggagtttgct

SEQ ID NO: 2179 - DNA, 20 bp, Artificial Sequence
  Synthetic construct
gtagatgccggagtttgctg

SEQ ID NO: 2180 - DNA, 20 bp, Artificial Sequence
  Synthetic construct
tagatgccggagtttgctgc

SEQ ID NO: 2181 - DNA, 20 bp, Artificial Sequence
  Synthetic construct
agatgccggagtttgctgcg

SEQ ID NO: 2182 - DNA, 20 bp, Artificial Sequence
  Synthetic construct
gatgccggagtttgctgcga

SEQ ID NO: 2183 - DNA, 20 bp, Artificial Sequence
  Synthetic construct
atgccggagtttgctgcgat

SEQ ID NO: 2184 - DNA, 20 bp, Artificial Sequence
  Synthetic construct
tgccggagtttgctgcgatt

SEQ ID NO: 2185 - DNA, 20 bp, Artificial Sequence
  Synthetic construct
gccggagtttgctgcgattg

SEQ ID NO: 2186 - DNA, 20 bp, Artificial Sequence
  Synthetic construct
ccggagtttgctgcgattgc

SEQ ID NO: 2187 - DNA, 20 bp, Artificial Sequence
  Synthetic construct
cggagtttgctgcgattgct

SEQ ID NO: 2188 - DNA, 20 bp, Artificial Sequence
  Synthetic construct
ggagtttgctgcgattgctg

SEQ ID NO: 2189 - DNA, 20 bp, Artificial Sequence
  Synthetic construct
gagtttgctgcgattgctga

SEQ ID NO: 2190 - DNA, 20 bp, Artificial Sequence
  Synthetic construct
agtttgctgcgattgctgag

SEQ ID NO: 2191 - DNA, 20 bp, Artificial Sequence
  Synthetic construct
gtttgctgcgattgctgagg

SEQ ID NO: 2192 - DNA, 20 bp, Artificial Sequence
  Synthetic construct
tttgctgcgattgctgaggg

SEQ ID NO: 2193 - DNA, 20 bp, Artificial Sequence
  Synthetic construct
ttgctgcgattgctgaggga

SEQ ID NO: 2194 - DNA, 20 bp, Artificial Sequence
  Synthetic construct
tgctgcgattgctgagggaa

SEQ ID NO: 2195 - DNA, 20 bp, Artificial Sequence
  Synthetic construct
gctgcgattgctgagggaat

SEQ ID NO: 2196 - DNA, 20 bp, Artificial Sequence
  Synthetic construct
ctgcgattgctgagggaatc

SEQ ID NO: 2197 - DNA, 20 bp, Artificial Sequence
  Synthetic construct
tgcgattgctgagggaatcg

SEQ ID NO: 2198 - DNA, 20 bp, Artificial Sequence
  Synthetic construct
gcgattgctgagggaatcgg

SEQ ID NO: 2199 - DNA, 20 bp, Artificial Sequence
  Synthetic construct
cgattgctgagggaatcggg

SEQ ID NO: 2200 - DNA, 20 bp, Artificial Sequence
  Synthetic construct
gattgctgagggaatcgggt

SEQ ID NO: 2201 - DNA, 20 bp, Artificial Sequence
  Synthetic construct
attgctgagggaatcgggtt

SEQ ID NO: 2202 - DNA, 20 bp, Artificial Sequence
  Synthetic construct
ttgctgagggaatcgggttt

SEQ ID NO: 2203 - DNA, 20 bp, Artificial Sequence
  Synthetic construct
tgctgagggaatcgggtttc

SEQ ID NO: 2204 - DNA, 20 bp, Artificial Sequence
  Synthetic construct
gctgagggaatcgggtttcc

SEQ ID NO: 2205 - DNA, 20 bp, Artificial Sequence
  Synthetic construct
ctgagggaatcgggtttcca

SEQ ID NO: 2206 - DNA, 20 bp, Artificial Sequence
  Synthetic construct
tgagggaatcgggtttccat

SEQ ID NO: 2207 - DNA, 20 bp, Artificial Sequence
  Synthetic construct
gagggaatcgggtttccatc

SEQ ID NO: 2208 - DNA, 20 bp, Artificial Sequence
  Synthetic construct
agggaatcgggtttccatct

SEQ ID NO: 2209 - DNA, 20 bp, Artificial Sequence
  Synthetic construct
gggaatcgggtttccatctt

SEQ ID NO: 2210 - DNA, 20 bp, Artificial Sequence
  Synthetic construct
ggaatcgggtttccatcttt

SEQ ID NO: 2211 - DNA, 20 bp, Artificial Sequence
  Synthetic construct
gaatcgggtttccatctttt

SEQ ID NO: 2212 - DNA, 20 bp, Artificial Sequence
  Synthetic construct
aatcgggtttccatctttta

SEQ ID NO: 2213 - DNA, 20 bp, Artificial Sequence
  Synthetic construct
atcgggtttccatcttttag

SEQ ID NO: 2214 - DNA, 20 bp, Artificial Sequence
  Synthetic construct
tcgggtttccatcttttagg

SEQ ID NO: 2215 - DNA, 20 bp, Artificial Sequence
  Synthetic construct
cgggtttccatcttttagga

SEQ ID NO: 2216 - DNA, 20 bp, Artificial Sequence
  Synthetic construct
gggtttccatcttttaggag

SEQ ID NO: 2217 - DNA, 20 bp, Artificial Sequence
  Synthetic construct
ggtttccatcttttaggaga

SEQ ID NO: 2218 - DNA, 20 bp, Artificial Sequence
  Synthetic construct
gtttccatcttttaggagac

SEQ ID NO: 2219 - DNA, 20 bp, Artificial Sequence
  Synthetic construct
tttccatcttttaggagacc

SEQ ID NO: 2220 - DNA, 20 bp, Artificial Sequence
  Synthetic construct
ttccatcttttaggagacct

SEQ ID NO: 2221 - DNA, 20 bp, Artificial Sequence
  Synthetic construct
tccatcttttaggagacctt

SEQ ID NO: 2222 - DNA, 20 bp, Artificial Sequence
  Synthetic construct
ccatcttttaggagaccttg

SEQ ID NO: 2223 - DNA, 20 bp, Artificial Sequence
  Synthetic construct
catcttttaggagaccttgc

SEQ ID NO: 2224 - DNA, 20 bp, Artificial Sequence
  Synthetic construct
atcttttaggagaccttgca

SEQ ID NO: 2225 - DNA, 20 bp, Artificial Sequence
  Synthetic construct
tcttttaggagaccttgcat

SEQ ID NO: 2226 - DNA, 20 bp, Artificial Sequence
  Synthetic construct
cttttaggagaccttgcatt

SEQ ID NO: 2227 - DNA, 20 bp, Artificial Sequence
  Synthetic construct
ttttaggagaccttgcattg

SEQ ID NO: 2228 - DNA, 20 bp, Artificial Sequence
  Synthetic construct
tttaggagaccttgcattgc

SEQ ID NO: 2229 - DNA, 20 bp, Artificial Sequence
  Synthetic construct
ttaggagaccttgcattgcc

SEQ ID NO: 2230 - DNA, 20 bp, Artificial Sequence
  Synthetic construct
taggagaccttgcattgcct

SEQ ID NO: 2231 - DNA, 20 bp, Artificial Sequence
  Synthetic construct
aggagaccttgcattgcctt

SEQ ID NO: 2232 - DNA, 20 bp, Artificial Sequence
  Synthetic construct
ggagaccttgcattgcctta

SEQ ID NO: 2233 - DNA, 20 bp, Artificial Sequence
  Synthetic construct
gagaccttgcattgccttaa

SEQ ID NO: 2234 - DNA, 20 bp, Artificial Sequence
  Synthetic construct
agaccttgcattgccttaac

SEQ ID NO: 2235 - DNA, 20 bp, Artificial Sequence
  Synthetic construct
gaccttgcattgccttaaca

SEQ ID NO: 2236 - DNA, 20 bp, Artificial Sequence
  Synthetic construct
accttgcattgccttaacaa

SEQ ID NO: 2237 - DNA, 20 bp, Artificial Sequence
  Synthetic construct
ccttgcattgccttaacaat

SEQ ID NO: 2238 - DNA, 20 bp, Artificial Sequence
  Synthetic construct
cttgcattgccttaacaata

SEQ ID NO: 2239 - DNA, 20 bp, Artificial Sequence
  Synthetic construct
ttgcattgccttaacaataa

SEQ ID NO: 2240 - DNA, 20 bp, Artificial Sequence
  Synthetic construct
tgcattgccttaacaataag

SEQ ID NO: 2241 - DNA, 20 bp, Artificial Sequence
  Synthetic construct
gcattgccttaacaataagc

SEQ ID NO: 2242 - DNA, 20 bp, Artificial Sequence
  Synthetic construct
cattgccttaacaataagct

SEQ ID NO: 2243 - DNA, 20 bp, Artificial Sequence
  Synthetic construct
attgccttaacaataagctc

SEQ ID NO: 2244 - DNA, 20 bp, Artificial Sequence
  Synthetic construct
ttgccttaacaataagctcg

SEQ ID NO: 2245 - DNA, 20 bp, Artificial Sequence
  Synthetic construct
tgccttaacaataagctcgc

SEQ ID NO: 2246 - DNA, 20 bp, Artificial Sequence
  Synthetic construct
gccttaacaataagctcgca

SEQ ID NO: 2247 - DNA, 20 bp, Artificial Sequence
  Synthetic construct
ccttaacaataagctcgcag

SEQ ID NO: 2248 - DNA, 20 bp, Artificial Sequence
  Synthetic construct
cttaacaataagctcgcagt

SEQ ID NO: 2249 - DNA, 20 bp, Artificial Sequence
  Synthetic construct
ttaacaataagctcgcagtc

SEQ ID NO: 2250 - DNA, 20 bp, Artificial Sequence
  Synthetic construct
taacaataagctcgcagtcg

SEQ ID NO: 2251 - DNA, 20 bp, Artificial Sequence
  Synthetic construct
aacaataagctcgcagtcgg

SEQ ID NO: 2252 - DNA, 20 bp, Artificial Sequence
  Synthetic construct
acaataagctcgcagtcgga

SEQ ID NO: 2253 - DNA, 20 bp, Artificial Sequence
  Synthetic construct
caataagctcgcagtcggaa

SEQ ID NO: 2254 - DNA, 20 bp, Artificial Sequence
  Synthetic construct
aataagctcgcagtcggaat

SEQ ID NO: 2255 - DNA, 20 bp, Artificial Sequence
  Synthetic construct
ataagctcgcagtcggaatt

SEQ ID NO: 2256 - DNA, 20 bp, Artificial Sequence
  Synthetic construct
taagctcgcagtcggaattc

SEQ ID NO: 2257 - DNA, 20 bp, Artificial Sequence
  Synthetic construct
aagctcgcagtcggaattcg

SEQ ID NO: 2258 - DNA, 20 bp, Artificial Sequence
  Synthetic construct
agctcgcagtcggaattcgt

SEQ ID NO: 2259 - DNA, 20 bp, Artificial Sequence
  Synthetic construct
gctcgcagtcggaattcgta

SEQ ID NO: 2260 - DNA, 20 bp, Artificial Sequence
  Synthetic construct
ctcgcagtcggaattcgtag

SEQ ID NO: 2261 - DNA, 20 bp, Artificial Sequence
  Synthetic construct
tcgcagtcggaattcgtagc

SEQ ID NO: 2262 - DNA, 20 bp, Artificial Sequence
  Synthetic construct
cgcagtcggaattcgtagcg

SEQ ID NO: 2263 - DNA, 20 bp, Artificial Sequence
  Synthetic construct
gcagtcggaattcgtagcga

SEQ ID NO: 2264 - DNA, 20 bp, Artificial Sequence
  Synthetic construct
cagtcggaattcgtagcgaa

SEQ ID NO: 2265 - DNA, 20 bp, Artificial Sequence
  Synthetic construct
agtcggaattcgtagcgaaa

SEQ ID NO: 2266 - DNA, 20 bp, Artificial Sequence
  Synthetic construct
gtcggaattcgtagcgaaaa

SEQ ID NO: 2267 - DNA, 20 bp, Artificial Sequence
  Synthetic construct
tcggaattcgtagcgaaaat

SEQ ID NO: 2268 - DNA, 20 bp, Artificial Sequence
  Synthetic construct
cggaattcgtagcgaaaatt

SEQ ID NO: 2269 - DNA, 20 bp, Artificial Sequence
  Synthetic construct
ggaattcgtagcgaaaattg

SEQ ID NO: 2270 - DNA, 20 bp, Artificial Sequence
  Synthetic construct
gaattcgtagcgaaaattgg

SEQ ID NO: 2271 - DNA, 20 bp, Artificial Sequence
  Synthetic construct
aattcgtagcgaaaattgga

SEQ ID NO: 2272 - DNA, 20 bp, Artificial Sequence
  Synthetic construct
attcgtagcgaaaattggaa

SEQ ID NO: 2273 - DNA, 20 bp, Artificial Sequence
  Synthetic construct
ttcgtagcgaaaattggaat

SEQ ID NO: 2274 - DNA, 20 bp, Artificial Sequence
  Synthetic construct
tcgtagcgaaaattggaatg

SEQ ID NO: 2275 - DNA, 20 bp, Artificial Sequence
  Synthetic construct
cgtagcgaaaattggaatgg

SEQ ID NO: 2276 - DNA, 20 bp, Artificial Sequence
  Synthetic construct
gtagcgaaaattggaatggt

SEQ ID NO: 2277 - DNA, 20 bp, Artificial Sequence
  Synthetic construct
tagcgaaaattggaatggtt

SEQ ID NO: 2278 - DNA, 20 bp, Artificial Sequence
  Synthetic construct
agcgaaaattggaatggtta

SEQ ID NO: 2279 - DNA, 20 bp, Artificial Sequence
  Synthetic construct
gcgaaaattggaatggttag

SEQ ID NO: 2280 - DNA, 20 bp, Artificial Sequence
  Synthetic construct
cgaaaattggaatggttagt

SEQ ID NO: 2281 - DNA, 20 bp, Artificial Sequence
  Synthetic construct
gaaaattggaatggttagtt

SEQ ID NO: 2282 - DNA, 20 bp, Artificial Sequence
  Synthetic construct
aaaattggaatggttagttc

SEQ ID NO: 2283 - DNA, 20 bp, Artificial Sequence
  Synthetic construct
aaattggaatggttagttcc

SEQ ID NO: 2284 - DNA, 20 bp, Artificial Sequence
  Synthetic construct
aattggaatggttagttcca

SEQ ID NO: 2285 - DNA, 20 bp, Artificial Sequence
  Synthetic construct
attggaatggttagttccat

SEQ ID NO: 2286 - DNA, 20 bp, Artificial Sequence
  Synthetic construct
ttggaatggttagttccata

SEQ ID NO: 2287 - DNA, 20 bp, Artificial Sequence
  Synthetic construct
tggaatggttagttccatat

SEQ ID NO: 2288 - DNA, 20 bp, Artificial Sequence
  Synthetic construct
ggaatggttagttccatatt

SEQ ID NO: 2289 - DNA, 20 bp, Artificial Sequence
  Synthetic construct
gaatggttagttccatattt

SEQ ID NO: 2290 - DNA, 20 bp, Artificial Sequence
  Synthetic construct
aatggttagttccatattta

SEQ ID NO: 2291 - DNA, 20 bp, Artificial Sequence
  Synthetic construct
atggttagttccatatttaa

SEQ ID NO: 2292 - DNA, 20 bp, Artificial Sequence
  Synthetic construct
tggttagttccatatttaag

SEQ ID NO: 2293 - DNA, 20 bp, Artificial Sequence
  Synthetic construct
ggttagttccatatttaagt

SEQ ID NO: 2294 - DNA, 20 bp, Artificial Sequence
  Synthetic construct
gttagttccatatttaagta

SEQ ID NO: 2295 - DNA, 20 bp, Artificial Sequence
  Synthetic construct
ttagttccatatttaagtac

SEQ ID NO: 2296 - DNA, 20 bp, Artificial Sequence
  Synthetic construct
tagttccatatttaagtacg

SEQ ID NO: 2297 - DNA, 20 bp, Artificial Sequence
  Synthetic construct
agttccatatttaagtacga

SEQ ID NO: 2298 - DNA, 20 bp, Artificial Sequence
  Synthetic construct
gttccatatttaagtacgaa

SEQ ID NO: 2299 - DNA, 20 bp, Artificial Sequence
  Synthetic construct
ttccatatttaagtacgaac

SEQ ID NO: 2300 - DNA, 20 bp, Artificial Sequence
  Synthetic construct
tccatatttaagtacgaacg

SEQ ID NO: 2301 - DNA, 20 bp, Artificial Sequence
  Synthetic construct
ccatatttaagtacgaacgc

SEQ ID NO: 2302 - DNA, 20 bp, Artificial Sequence
  Synthetic construct
catatttaagtacgaacgcc

SEQ ID NO: 2303 - DNA, 20 bp, Artificial Sequence
  Synthetic construct
atatttaagtacgaacgcca

SEQ ID NO: 2304 - DNA, 20 bp, Artificial Sequence
  Synthetic construct
tatttaagtacgaacgccat

SEQ ID NO: 2305 - DNA, 20 bp, Artificial Sequence
  Synthetic construct
atttaagtacgaacgccatg

SEQ ID NO: 2306 - DNA, 20 bp, Artificial Sequence
  Synthetic construct
tttaagtacgaacgccatgc

SEQ ID NO: 2307 - DNA, 20 bp, Artificial Sequence
  Synthetic construct
ttaagtacgaacgccatgcg

SEQ ID NO: 2308 - DNA, 20 bp, Artificial Sequence
  Synthetic construct
taagtacgaacgccatgcgg

SEQ ID NO: 2309 - DNA, 20 bp, Artificial Sequence
  Synthetic construct
aagtacgaacgccatgcggc

SEQ ID NO: 2310 - DNA, 20 bp, Artificial Sequence
  Synthetic construct
agtacgaacgccatgcggct

SEQ ID NO: 2311 - DNA, 20 bp, Artificial Sequence
  Synthetic construct
gtacgaacgccatgcggcta

SEQ ID NO: 2312 - DNA, 20 bp, Artificial Sequence
  Synthetic construct
tacgaacgccatgcggctac

SEQ ID NO: 2313 - DNA, 20 bp, Artificial Sequence
  Synthetic construct
acgaacgccatgcggctaca

SEQ ID NO: 2314 - DNA, 20 bp, Artificial Sequence
  Synthetic construct
cgaacgccatgcggctacag

SEQ ID NO: 2315 - DNA, 20 bp, Artificial Sequence
  Synthetic construct
gaacgccatgcggctacagg

SEQ ID NO: 2316 - DNA, 20 bp, Artificial Sequence
  Synthetic construct
aacgccatgcggctacagga

SEQ ID NO: 2317 - DNA, 20 bp, Artificial Sequence
  Synthetic construct
acgccatgcggctacaggaa

SEQ ID NO: 2318 - DNA, 20 bp, Artificial Sequence
  Synthetic construct
cgccatgcggctacaggaag

SEQ ID NO: 2319 - DNA, 20 bp, Artificial Sequence
  Synthetic construct
gccatgcggctacaggaagc

SEQ ID NO: 2320 - DNA, 20 bp, Artificial Sequence
  Synthetic construct
ccatgcggctacaggaagct

SEQ ID NO: 2321 - DNA, 20 bp, Artificial Sequence
  Synthetic construct
catgcggctacaggaagctc

SEQ ID NO: 2322 - DNA, 20 bp, Artificial Sequence
  Synthetic construct
atgcggctacaggaagctct

SEQ ID NO: 2323 - DNA, 20 bp, Artificial Sequence
  Synthetic construct
tgcggctacaggaagctcta

SEQ ID NO: 2324 - DNA, 20 bp, Artificial Sequence
  Synthetic construct
gcggctacaggaagctctac

SEQ ID NO: 2325 - DNA, 20 bp, Artificial Sequence
  Synthetic construct
cggctacaggaagctctaca

SEQ ID NO: 2326 - DNA, 20 bp, Artificial Sequence
  Synthetic construct
ggctacaggaagctctacac

SEQ ID NO: 2327 - DNA, 20 bp, Artificial Sequence
  Synthetic construct
gctacaggaagctctacacc

SEQ ID NO: 2328 - DNA, 20 bp, Artificial Sequence
  Synthetic construct
ctacaggaagctctacacca

SEQ ID NO: 2329 - DNA, 20 bp, Artificial Sequence
  Synthetic construct
tacaggaagctctacaccac

SEQ ID NO: 2330 - DNA, 20 bp, Artificial Sequence
  Synthetic construct
acaggaagctctacaccacc

SEQ ID NO: 2331 - DNA, 20 bp, Artificial Sequence
  Synthetic construct
caggaagctctacaccacca

SEQ ID NO: 2332 - DNA, 20 bp, Artificial Sequence
  Synthetic construct
aggaagctctacaccaccaa

SEQ ID NO: 2333 - DNA, 20 bp, Artificial Sequence
  Synthetic construct
ggaagctctacaccaccaac

SEQ ID NO: 2334 - DNA, 20 bp, Artificial Sequence
  Synthetic construct
gaagctctacaccaccaaca

SEQ ID NO: 2335 - DNA, 20 bp, Artificial Sequence
  Synthetic construct
aagctctacaccaccaacag

SEQ ID NO: 2336 - DNA, 20 bp, Artificial Sequence
  Synthetic construct
agctctacaccaccaacagt

SEQ ID NO: 2337 - DNA, 20 bp, Artificial Sequence
  Synthetic construct
gctctacaccaccaacagtc

SEQ ID NO: 2338 - DNA, 20 bp, Artificial Sequence
  Synthetic construct
ctctacaccaccaacagtct

SEQ ID NO: 2339 - DNA, 20 bp, Artificial Sequence
  Synthetic construct
tctacaccaccaacagtctg

SEQ ID NO: 2340 - DNA, 20 bp, Artificial Sequence
  Synthetic construct
ctacaccaccaacagtctgg

SEQ ID NO: 2341 - DNA, 20 bp, Artificial Sequence
  Synthetic construct
tacaccaccaacagtctggg

SEQ ID NO: 2342 - DNA, 20 bp, Artificial Sequence
  Synthetic construct
acaccaccaacagtctgggt

SEQ ID NO: 2343 - DNA, 20 bp, Artificial Sequence
  Synthetic construct
caccaccaacagtctgggtt

SEQ ID NO: 2344 - DNA, 20 bp, Artificial Sequence
  Synthetic construct
accaccaacagtctgggttg

SEQ ID NO: 2345 - DNA, 20 bp, Artificial Sequence
  Synthetic construct
ccaccaacagtctgggttgc

SEQ ID NO: 2346 - DNA, 20 bp, Artificial Sequence
  Synthetic construct
caccaacagtctgggttgcc

SEQ ID NO: 2347 - DNA, 20 bp, Artificial Sequence
  Synthetic construct
accaacagtctgggttgcca

SEQ ID NO: 2348 - DNA, 20 bp, Artificial Sequence
  Synthetic construct
ccaacagtctgggttgccac

SEQ ID NO: 2349 - DNA, 20 bp, Artificial Sequence
  Synthetic construct
caacagtctgggttgccact

SEQ ID NO: 2350 - DNA, 20 bp, Artificial Sequence
  Synthetic construct
aacagtctgggttgccactt

SEQ ID NO: 2351 - DNA, 20 bp, Artificial Sequence
  Synthetic construct
acagtctgggttgccacttt

SEQ ID NO: 2352 - DNA, 20 bp, Artificial Sequence
  Synthetic construct
cagtctgggttgccacttta

SEQ ID NO: 2353 - DNA, 20 bp, Artificial Sequence
  Synthetic construct
agtctgggttgccactttag

SEQ ID NO: 2354 - DNA, 20 bp, Artificial Sequence
  Synthetic construct
gtctgggttgccactttagg

SEQ ID NO: 2355 - DNA, 20 bp, Artificial Sequence
  Synthetic construct
tctgggttgccactttaggc

SEQ ID NO: 2356 - DNA, 20 bp, Artificial Sequence
  Synthetic construct
ctgggttgccactttaggca

SEQ ID NO: 2357 - DNA, 20 bp, Artificial Sequence
  Synthetic construct
tgggttgccactttaggcac

SEQ ID NO: 2358 - DNA, 20 bp, Artificial Sequence
  Synthetic construct
gggttgccactttaggcacc

SEQ ID NO: 2359 - DNA, 20 bp, Artificial Sequence
  Synthetic construct
ggttgccactttaggcacct

SEQ ID NO: 2360 - DNA, 20 bp, Artificial Sequence
  Synthetic construct
gttgccactttaggcacctc

SEQ ID NO: 2361 - DNA, 20 bp, Artificial Sequence
  Synthetic construct
ttgccactttaggcacctcg

SEQ ID NO: 2362 - DNA, 20 bp, Artificial Sequence
  Synthetic construct
tgccactttaggcacctcga

SEQ ID NO: 2363 - DNA, 20 bp, Artificial Sequence
  Synthetic construct
gccactttaggcacctcgac

SEQ ID NO: 2364 - DNA, 20 bp, Artificial Sequence
  Synthetic construct
ccactttaggcacctcgact

SEQ ID NO: 2365 - DNA, 20 bp, Artificial Sequence
  Synthetic construct
cactttaggcacctcgactt

SEQ ID NO: 2366 - DNA, 20 bp, Artificial Sequence
  Synthetic construct
actttaggcacctcgacttt

SEQ ID NO: 2367 - DNA, 20 bp, Artificial Sequence
  Synthetic construct
ctttaggcacctcgactttg

SEQ ID NO: 2368 - DNA, 20 bp, Artificial Sequence
  Synthetic construct
tttaggcacctcgactttga

SEQ ID NO: 2369 - DNA, 20 bp, Artificial Sequence
  Synthetic construct
ttaggcacctcgactttgat

SEQ ID NO: 2370 - DNA, 20 bp, Artificial Sequence
  Synthetic construct
taggcacctcgactttgatg

SEQ ID NO: 2371 - DNA, 20 bp, Artificial Sequence
  Synthetic construct
aggcacctcgactttgatgg

SEQ ID NO: 2372 - DNA, 20 bp, Artificial Sequence
  Synthetic construct
ggcacctcgactttgatggt

SEQ ID NO: 2373 - DNA, 20 bp, Artificial Sequence
  Synthetic construct
gcacctcgactttgatggtg

SEQ ID NO: 2374 - DNA, 20 bp, Artificial Sequence
  Synthetic construct
cacctcgactttgatggtgt

SEQ ID NO: 2375 - DNA, 20 bp, Artificial Sequence
  Synthetic construct
acctcgactttgatggtgta

SEQ ID NO: 2376 - DNA, 20 bp, Artificial Sequence
  Synthetic construct
cctcgactttgatggtgtat

SEQ ID NO: 2377 - DNA, 20 bp, Artificial Sequence
  Synthetic construct
ctcgactttgatggtgtatt

SEQ ID NO: 2378 - DNA, 20 bp, Artificial Sequence
  Synthetic construct
tcgactttgatggtgtattt

SEQ ID NO: 2379 - DNA, 20 bp, Artificial Sequence
  Synthetic construct
cgactttgatggtgtatttg

SEQ ID NO: 2380 - DNA, 20 bp, Artificial Sequence
  Synthetic construct
gactttgatggtgtatttgc

SEQ ID NO: 2381 - DNA, 20 bp, Artificial Sequence
  Synthetic construct
actttgatggtgtatttgcg

SEQ ID NO: 2382 - DNA, 20 bp, Artificial Sequence
  Synthetic construct
ctttgatggtgtatttgcga

SEQ ID NO: 2383 - DNA, 20 bp, Artificial Sequence
  Synthetic construct
tttgatggtgtatttgcgat

SEQ ID NO: 2384 - DNA, 20 bp, Artificial Sequence
  Synthetic construct
ttgatggtgtatttgcgatt

SEQ ID NO: 2385 - DNA, 20 bp, Artificial Sequence
  Synthetic construct
tgatggtgtatttgcgattc

SEQ ID NO: 2386 - DNA, 20 bp, Artificial Sequence
  Synthetic construct
gatggtgtatttgcgattct

SEQ ID NO: 2387 - DNA, 20 bp, Artificial Sequence
  Synthetic construct
atggtgtatttgcgattctg

SEQ ID NO: 2388 - DNA, 20 bp, Artificial Sequence
  Synthetic construct
tggtgtatttgcgattctgc

SEQ ID NO: 2389 - DNA, 20 bp, Artificial Sequence
  Synthetic construct
ggtgtatttgcgattctgcg

SEQ ID NO: 2390 - DNA, 20 bp, Artificial Sequence
  Synthetic construct
gtgtatttgcgattctgcgc

SEQ ID NO: 2391 - DNA, 20 bp, Artificial Sequence
  Synthetic construct
tgtatttgcgattctgcgca

SEQ ID NO: 2392 - DNA, 20 bp, Artificial Sequence
  Synthetic construct
gtatttgcgattctgcgcag

SEQ ID NO: 2393 - DNA, 20 bp, Artificial Sequence
  Synthetic construct
tatttgcgattctgcgcaga

SEQ ID NO: 2394 - DNA, 20 bp, Artificial Sequence
  Synthetic construct
atttgcgattctgcgcagag

SEQ ID NO: 2395 - DNA, 20 bp, Artificial Sequence
  Synthetic construct
tttgcgattctgcgcagagc

SEQ ID NO: 2396 - DNA, 20 bp, Artificial Sequence
  Synthetic construct
ttgcgattctgcgcagagct

SEQ ID NO: 2397 - DNA, 20 bp, Artificial Sequence
  Synthetic construct
tgcgattctgcgcagagctc

SEQ ID NO: 2398 - DNA, 20 bp, Artificial Sequence
  Synthetic construct
gcgattctgcgcagagctct

SEQ ID NO: 2399 - DNA, 20 bp, Artificial Sequence
  Synthetic construct
cgattctgcgcagagctctg

SEQ ID NO: 2400 - DNA, 20 bp, Artificial Sequence
  Synthetic construct
gattctgcgcagagctctga

SEQ ID NO: 2401 - DNA, 20 bp, Artificial Sequence
  Synthetic construct
attctgcgcagagctctgac

SEQ ID NO: 2402 - DNA, 20 bp, Artificial Sequence
  Synthetic construct
ttctgcgcagagctctgacg

SEQ ID NO: 2403 - DNA, 20 bp, Artificial Sequence
  Synthetic construct
tctgcgcagagctctgacga

SEQ ID NO: 2404 - DNA, 20 bp, Artificial Sequence
  Synthetic construct
ctgcgcagagctctgacgaa

SEQ ID NO: 2405 - DNA, 20 bp, Artificial Sequence
  Synthetic construct
tgcgcagagctctgacgaac

SEQ ID NO: 2406 - DNA, 20 bp, Artificial Sequence
  Synthetic construct
gcgcagagctctgacgaacg

SEQ ID NO: 2407 - DNA, 20 bp, Artificial Sequence
  Synthetic construct
cgcagagctctgacgaacgc

SEQ ID NO: 2408 - DNA, 20 bp, Artificial Sequence
  Synthetic construct
gcagagctctgacgaacgct

SEQ ID NO: 2409 - DNA, 20 bp, Artificial Sequence
  Synthetic construct
cagagctctgacgaacgcta

SEQ ID NO: 2410 - DNA, 20 bp, Artificial Sequence
  Synthetic construct
agagctctgacgaacgctac

SEQ ID NO: 2411 - DNA, 20 bp, Artificial Sequence
  Synthetic construct
gagctctgacgaacgctaca

SEQ ID NO: 2412 - DNA, 20 bp, Artificial Sequence
  Synthetic construct
agctctgacgaacgctacag

SEQ ID NO: 2413 - DNA, 20 bp, Artificial Sequence
  Synthetic construct
gctctgacgaacgctacagg

SEQ ID NO: 2414 - DNA, 20 bp, Artificial Sequence
  Synthetic construct
ctctgacgaacgctacaggt

SEQ ID NO: 2415 - DNA, 20 bp, Artificial Sequence
  Synthetic construct
tctgacgaacgctacaggtt

SEQ ID NO: 2416 - DNA, 20 bp, Artificial Sequence
  Synthetic construct
ctgacgaacgctacaggtta

SEQ ID NO: 2417 - DNA, 20 bp, Artificial Sequence
  Synthetic construct
tgacgaacgctacaggttac

SEQ ID NO: 2418 - DNA, 20 bp, Artificial Sequence
  Synthetic construct
gacgaacgctacaggttact

SEQ ID NO: 2419 - DNA, 20 bp, Artificial Sequence
  Synthetic construct
acgaacgctacaggttactt

SEQ ID NO: 2420 - DNA, 20 bp, Artificial Sequence
  Synthetic construct
cgaacgctacaggttacttt

SEQ ID NO: 2421 - DNA, 20 bp, Artificial Sequence
  Synthetic construct
gaacgctacaggttactttg

SEQ ID NO: 2422 - DNA, 20 bp, Artificial Sequence
  Synthetic construct
aacgctacaggttactttgt

SEQ ID NO: 2423 - DNA, 20 bp, Artificial Sequence
  Synthetic construct
acgctacaggttactttgta

SEQ ID NO: 2424 - DNA, 20 bp, Artificial Sequence
  Synthetic construct
cgctacaggttactttgtaa

SEQ ID NO: 2425 - DNA, 20 bp, Artificial Sequence
  Synthetic construct
gctacaggttactttgtaag

SEQ ID NO: 2426 - DNA, 20 bp, Artificial Sequence
  Synthetic construct
ctacaggttactttgtaagc

SEQ ID NO: 2427 - DNA, 20 bp, Artificial Sequence
  Synthetic construct
tacaggttactttgtaagcc

SEQ ID NO: 2428 - DNA, 20 bp, Artificial Sequence
  Synthetic construct
acaggttactttgtaagcct

SEQ ID NO: 2429 - DNA, 20 bp, Artificial Sequence
  Synthetic construct
caggttactttgtaagcctg

SEQ ID NO: 2430 - DNA, 20 bp, Artificial Sequence
  Synthetic construct
aggttactttgtaagcctgt

SEQ ID NO: 2431 - DNA, 20 bp, Artificial Sequence
  Synthetic construct
ggttactttgtaagcctgtg

SEQ ID NO: 2432 - DNA, 20 bp, Artificial Sequence
  Synthetic construct
gttactttgtaagcctgtga

SEQ ID NO: 2433 - DNA, 20 bp, Artificial Sequence
  Synthetic construct
ttactttgtaagcctgtgaa

SEQ ID NO: 2434 - DNA, 20 bp, Artificial Sequence
  Synthetic construct
tactttgtaagcctgtgaac

SEQ ID NO: 2435 - DNA, 20 bp, Artificial Sequence
  Synthetic construct
actttgtaagcctgtgaacg

SEQ ID NO: 2436 - DNA, 20 bp, Artificial Sequence
  Synthetic construct
ctttgtaagcctgtgaacgc

SEQ ID NO: 2437 - DNA, 20 bp, Artificial Sequence
  Synthetic construct
tttgtaagcctgtgaacgcg

SEQ ID NO: 2438 - DNA, 20 bp, Artificial Sequence
  Synthetic construct
ttgtaagcctgtgaacgcga

SEQ ID NO: 2439 - DNA, 20 bp, Artificial Sequence
  Synthetic construct
tgtaagcctgtgaacgcgag

SEQ ID NO: 2440 - DNA, 20 bp, Artificial Sequence
  Synthetic construct
gtaagcctgtgaacgcgagt

SEQ ID NO: 2441 - DNA, 20 bp, Artificial Sequence
  Synthetic construct
taagcctgtgaacgcgagtt

SEQ ID NO: 2442 - DNA, 20 bp, Artificial Sequence
  Synthetic construct
aagcctgtgaacgcgagtta

SEQ ID NO: 2443 - DNA, 20 bp, Artificial Sequence
  Synthetic construct
agcctgtgaacgcgagttag

SEQ ID NO: 2444 - DNA, 20 bp, Artificial Sequence
  Synthetic construct
gcctgtgaacgcgagttaga

SEQ ID NO: 2445 - DNA, 20 bp, Artificial Sequence
  Synthetic construct
cctgtgaacgcgagttagag

SEQ ID NO: 2446 - DNA, 20 bp, Artificial Sequence
  Synthetic construct
ctgtgaacgcgagttagagc

SEQ ID NO: 2447 - DNA, 20 bp, Artificial Sequence
  Synthetic construct
tgtgaacgcgagttagagct

SEQ ID NO: 2448 - DNA, 20 bp, Artificial Sequence
  Synthetic construct
gtgaacgcgagttagagctg

SEQ ID NO: 2449 - DNA, 20 bp, Artificial Sequence
  Synthetic construct
tgaacgcgagttagagctga

SEQ ID NO: 2450 - DNA, 20 bp, Artificial Sequence
  Synthetic construct
gaacgcgagttagagctgat

SEQ ID NO: 2451 - DNA, 20 bp, Artificial Sequence
  Synthetic construct
aacgcgagttagagctgatc

SEQ ID NO: 2452 - DNA, 20 bp, Artificial Sequence
  Synthetic construct
acgcgagttagagctgatcc

SEQ ID NO: 2453 - DNA, 20 bp, Artificial Sequence
  Synthetic construct
cgcgagttagagctgatcca

SEQ ID NO: 2454 - DNA, 20 bp, Artificial Sequence
  Synthetic construct
gcgagttagagctgatccat

SEQ ID NO: 2455 - DNA, 20 bp, Artificial Sequence
  Synthetic construct
cgagttagagctgatccatt

SEQ ID NO: 2456 - DNA, 20 bp, Artificial Sequence
  Synthetic construct
gagttagagctgatccattc

SEQ ID NO: 2457 - DNA, 20 bp, Artificial Sequence
  Synthetic construct
agttagagctgatccattca

SEQ ID NO: 2458 - DNA, 20 bp, Artificial Sequence
  Synthetic construct
gttagagctgatccattcag

SEQ ID NO: 2459 - DNA, 20 bp, Artificial Sequence
  Synthetic construct
ttagagctgatccattcagc

SEQ ID NO: 2460 - DNA, 20 bp, Artificial Sequence
  Synthetic construct
tagagctgatccattcagcg

SEQ ID NO: 2461 - DNA, 20 bp, Artificial Sequence
  Synthetic construct
agagctgatccattcagcga

SEQ ID NO: 2462 - DNA, 20 bp, Artificial Sequence
  Synthetic construct
gagctgatccattcagcgac

SEQ ID NO: 2463 - DNA, 20 bp, Artificial Sequence
  Synthetic construct
agctgatccattcagcgacc

SEQ ID NO: 2464 - DNA, 20 bp, Artificial Sequence
  Synthetic construct
gctgatccattcagcgaccc

SEQ ID NO: 2465 - DNA, 20 bp, Artificial Sequence
  Synthetic construct
ctgatccattcagcgacccc

SEQ ID NO: 2466 - DNA, 20 bp, Artificial Sequence
  Synthetic construct
tgatccattcagcgaccccg

SEQ ID NO: 2467 - DNA, 20 bp, Artificial Sequence
  Synthetic construct
gatccattcagcgaccccgt

SEQ ID NO: 2468 - DNA, 20 bp, Artificial Sequence
  Synthetic construct
atccattcagcgaccccgtt

SEQ ID NO: 2469 - DNA, 20 bp, Artificial Sequence
  Synthetic construct
tccattcagcgaccccgtta

SEQ ID NO: 2470 - DNA, 20 bp, Artificial Sequence
  Synthetic construct
ccattcagcgaccccgttag

SEQ ID NO: 2471 - DNA, 20 bp, Artificial Sequence
  Synthetic construct
cattcagcgaccccgttagc

SEQ ID NO: 2472 - DNA, 20 bp, Artificial Sequence
  Synthetic construct
attcagcgaccccgttagcg

SEQ ID NO: 2473 - DNA, 20 bp, Artificial Sequence
  Synthetic construct
ttcagcgaccccgttagcga

SEQ ID NO: 2474 - DNA, 20 bp, Artificial Sequence
  Synthetic construct
tcagcgaccccgttagcgaa

SEQ ID NO: 2475 - DNA, 20 bp, Artificial Sequence
  Synthetic construct
cagcgaccccgttagcgaag

SEQ ID NO: 2476 - DNA, 20 bp, Artificial Sequence
  Synthetic construct
agcgaccccgttagcgaagt

SEQ ID NO: 2477 - DNA, 20 bp, Artificial Sequence
  Synthetic construct
gcgaccccgttagcgaagtt

SEQ ID NO: 2478 - DNA, 20 bp, Artificial Sequence
  Synthetic construct
cgaccccgttagcgaagttg

SEQ ID NO: 2479 - DNA, 20 bp, Artificial Sequence
  Synthetic construct
gaccccgttagcgaagttgc

SEQ ID NO: 2480 - DNA, 20 bp, Artificial Sequence
  Synthetic construct
accccgttagcgaagttgct

SEQ ID NO: 2481 - DNA, 20 bp, Artificial Sequence
  Synthetic construct
ccccgttagcgaagttgctt

SEQ ID NO: 2482 - DNA, 20 bp, Artificial Sequence
  Synthetic construct
cccgttagcgaagttgcttg

SEQ ID NO: 2483 - DNA, 20 bp, Artificial Sequence
  Synthetic construct
ccgttagcgaagttgcttgg

SEQ ID NO: 2484 - DNA, 20 bp, Artificial Sequence
  Synthetic construct
cgttagcgaagttgcttggg

SEQ ID NO: 2485 - DNA, 20 bp, Artificial Sequence
  Synthetic construct
gttagcgaagttgcttgggg

SEQ ID NO: 2486 - DNA, 20 bp, Artificial Sequence
  Synthetic construct
ttagcgaagttgcttggggc

SEQ ID NO: 2487 - DNA, 20 bp, Artificial Sequence
  Synthetic construct
tagcgaagttgcttggggcg

SEQ ID NO: 2488 - DNA, 20 bp, Artificial Sequence
  Synthetic construct
agcgaagttgcttggggcga

SEQ ID NO: 2489 - DNA, 20 bp, Artificial Sequence
  Synthetic construct
gcgaagttgcttggggcgac

SEQ ID NO: 2490 - DNA, 20 bp, Artificial Sequence
  Synthetic construct
cgaagttgcttggggcgaca

SEQ ID NO: 2491 - DNA, 20 bp, Artificial Sequence
  Synthetic construct
gaagttgcttggggcgacag

SEQ ID NO: 2492 - DNA, 20 bp, Artificial Sequence
  Synthetic construct
aagttgcttggggcgacagt

SEQ ID NO: 2493 - DNA, 20 bp, Artificial Sequence
  Synthetic construct
agttgcttggggcgacagtc

SEQ ID NO: 2494 - DNA, 20 bp, Artificial Sequence
  Synthetic construct
gttgcttggggcgacagtca

SEQ ID NO: 2495 - DNA, 20 bp, Artificial Sequence
  Synthetic construct
ttgcttggggcgacagtcac

SEQ ID NO: 2496 - DNA, 20 bp, Artificial Sequence
  Synthetic construct
tgcttggggcgacagtcacg

SEQ ID NO: 2497 - DNA, 20 bp, Artificial Sequence
  Synthetic construct
gcttggggcgacagtcacgt

SEQ ID NO: 2498 - DNA, 20 bp, Artificial Sequence
  Synthetic construct
cttggggcgacagtcacgtc

SEQ ID NO: 2499 - DNA, 20 bp, Artificial Sequence
  Synthetic construct
ttggggcgacagtcacgtcg

SEQ ID NO: 2500 - DNA, 20 bp, Artificial Sequence
  Synthetic construct
tggggcgacagtcacgtcgc

SEQ ID NO: 2501 - DNA, 20 bp, Artificial Sequence
  Synthetic construct
ggggcgacagtcacgtcgcc

SEQ ID NO: 2502 - DNA, 20 bp, Artificial Sequence
  Synthetic construct
gggcgacagtcacgtcgcca

SEQ ID NO: 2503 - DNA, 20 bp, Artificial Sequence
  Synthetic construct
ggcgacagtcacgtcgccag

SEQ ID NO: 2504 - DNA, 20 bp, Artificial Sequence
  Synthetic construct
gcgacagtcacgtcgccagt

SEQ ID NO: 2505 - DNA, 20 bp, Artificial Sequence
  Synthetic construct
cgacagtcacgtcgccagtt

SEQ ID NO: 2506 - DNA, 20 bp, Artificial Sequence
  Synthetic construct
gacagtcacgtcgccagttc

SEQ ID NO: 2507 - DNA, 20 bp, Artificial Sequence
  Synthetic construct
acagtcacgtcgccagttcc

SEQ ID NO: 2508 - DNA, 20 bp, Artificial Sequence
  Synthetic construct
cagtcacgtcgccagttccg

SEQ ID NO: 2509 - DNA, 20 bp, Artificial Sequence
  Synthetic construct
agtcacgtcgccagttccgc

SEQ ID NO: 2510 - DNA, 20 bp, Artificial Sequence
  Synthetic construct
gtcacgtcgccagttccgcc

SEQ ID NO: 2511 - DNA, 20 bp, Artificial Sequence
  Synthetic construct
tcacgtcgccagttccgcca

SEQ ID NO: 2512 - DNA, 20 bp, Artificial Sequence
  Synthetic construct
cacgtcgccagttccgccat

SEQ ID NO: 2513 - DNA, 20 bp, Artificial Sequence
  Synthetic construct
acgtcgccagttccgccatt

SEQ ID NO: 2514 - DNA, 20 bp, Artificial Sequence
  Synthetic construct
cgtcgccagttccgccattg

SEQ ID NO: 2515 - DNA, 20 bp, Artificial Sequence
  Synthetic construct
gtcgccagttccgccattgt

SEQ ID NO: 2516 - DNA, 20 bp, Artificial Sequence
  Synthetic construct
tcgccagttccgccattgtc

SEQ ID NO: 2517 - DNA, 20 bp, Artificial Sequence
  Synthetic construct
cgccagttccgccattgtcg

SEQ ID NO: 2518 - DNA, 20 bp, Artificial Sequence
  Synthetic construct
gccagttccgccattgtcga

SEQ ID NO: 2519 - DNA, 20 bp, Artificial Sequence
  Synthetic construct
ccagttccgccattgtcgac

SEQ ID NO: 2520 - DNA, 20 bp, Artificial Sequence
  Synthetic construct
cagttccgccattgtcgacg

SEQ ID NO: 2521 - DNA, 20 bp, Artificial Sequence
  Synthetic construct
agttccgccattgtcgacga

SEQ ID NO: 2522 - DNA, 20 bp, Artificial Sequence
  Synthetic construct
gttccgccattgtcgacgag

SEQ ID NO: 2523 - DNA, 20 bp, Artificial Sequence
  Synthetic construct
ttccgccattgtcgacgaga

SEQ ID NO: 2524 - DNA, 20 bp, Artificial Sequence
  Synthetic construct
tccgccattgtcgacgagaa

SEQ ID NO: 2525 - DNA, 20 bp, Artificial Sequence
  Synthetic construct
ccgccattgtcgacgagaac

SEQ ID NO: 2526 - DNA, 20 bp, Artificial Sequence
  Synthetic construct
cgccattgtcgacgagaacg

SEQ ID NO: 2527 - DNA, 20 bp, Artificial Sequence
  Synthetic construct
gccattgtcgacgagaacga

SEQ ID NO: 2528 - DNA, 20 bp, Artificial Sequence
  Synthetic construct
ccattgtcgacgagaacgaa

SEQ ID NO: 2529 - DNA, 20 bp, Artificial Sequence
  Synthetic construct
cattgtcgacgagaacgaac

SEQ ID NO: 2530 - DNA, 20 bp, Artificial Sequence
  Synthetic construct
attgtcgacgagaacgaact

SEQ ID NO: 2531 - DNA, 20 bp, Artificial Sequence
  Synthetic construct
ttgtcgacgagaacgaactg

SEQ ID NO: 2532 - DNA, 20 bp, Artificial Sequence
  Synthetic construct
tgtcgacgagaacgaactga

SEQ ID NO: 2533 - DNA, 20 bp, Artificial Sequence
  Synthetic construct
gtcgacgagaacgaactgag

SEQ ID NO: 2534 - DNA, 20 bp, Artificial Sequence
  Synthetic construct
tcgacgagaacgaactgagt

SEQ ID NO: 2535 - DNA, 20 bp, Artificial Sequence
  Synthetic construct
cgacgagaacgaactgagta

SEQ ID NO: 2536 - DNA, 20 bp, Artificial Sequence
  Synthetic construct
gacgagaacgaactgagtaa

SEQ ID NO: 2537 - DNA, 20 bp, Artificial Sequence
  Synthetic construct
acgagaacgaactgagtaaa

SEQ ID NO: 2538 - DNA, 20 bp, Artificial Sequence
  Synthetic construct
cgagaacgaactgagtaaag

SEQ ID NO: 2539 - DNA, 20 bp, Artificial Sequence
  Synthetic construct
gagaacgaactgagtaaagt

SEQ ID NO: 2540 - DNA, 20 bp, Artificial Sequence
  Synthetic construct
agaacgaactgagtaaagtt

SEQ ID NO: 2541 - DNA, 20 bp, Artificial Sequence
  Synthetic construct
gaacgaactgagtaaagtta

SEQ ID NO: 2542 - DNA, 20 bp, Artificial Sequence
  Synthetic construct
aacgaactgagtaaagttag

SEQ ID NO: 2543 - DNA, 20 bp, Artificial Sequence
  Synthetic construct
acgaactgagtaaagttaga

SEQ ID NO: 2544 - DNA, 20 bp, Artificial Sequence
  Synthetic construct
cgaactgagtaaagttagaa

SEQ ID NO: 2545 - DNA, 20 bp, Artificial Sequence
  Synthetic construct
gaactgagtaaagttagaag

SEQ ID NO: 2546 - DNA, 20 bp, Artificial Sequence
  Synthetic construct
aactgagtaaagttagaagc

SEQ ID NO: 2547 - DNA, 20 bp, Artificial Sequence
  Synthetic construct
actgagtaaagttagaagcc

SEQ ID NO: 2548 - DNA, 20 bp, Artificial Sequence
  Synthetic construct
ctgagtaaagttagaagcca

SEQ ID NO: 2549 - DNA, 20 bp, Artificial Sequence
  Synthetic construct
tgagtaaagttagaagccat

SEQ ID NO: 2550 - DNA, 20 bp, Artificial Sequence
  Synthetic construct
gagtaaagttagaagccatg

SEQ ID NO: 2551 - DNA, 20 bp, Artificial Sequence
  Synthetic construct
agtaaagttagaagccatgc

SEQ ID NO: 2552 - DNA, 20 bp, Artificial Sequence
  Synthetic construct
gtaaagttagaagccatgct

SEQ ID NO: 2553 - DNA, 20 bp, Artificial Sequence
  Synthetic construct
taaagttagaagccatgctt

SEQ ID NO: 2554 - DNA, 20 bp, Artificial Sequence
  Synthetic construct
aaagttagaagccatgcttc

SEQ ID NO: 2555 - DNA, 20 bp, Artificial Sequence
  Synthetic construct
aagttagaagccatgcttca

SEQ ID NO: 2556 - DNA, 20 bp, Artificial Sequence
  Synthetic construct
agttagaagccatgcttcaa

SEQ ID NO: 2557 - DNA, 20 bp, Artificial Sequence
  Synthetic construct
gttagaagccatgcttcaaa

SEQ ID NO: 2558 - DNA, 20 bp, Artificial Sequence
  Synthetic construct
ttagaagccatgcttcaaac

SEQ ID NO: 2559 - DNA, 20 bp, Artificial Sequence
  Synthetic construct
tagaagccatgcttcaaact

SEQ ID NO: 2560 - DNA, 20 bp, Artificial Sequence
  Synthetic construct
agaagccatgcttcaaactc

SEQ ID NO: 2561 - DNA, 20 bp, Artificial Sequence
  Synthetic construct
gaagccatgcttcaaactcc

SEQ ID NO: 2562 - DNA, 20 bp, Artificial Sequence
  Synthetic construct
aagccatgcttcaaactccg

SEQ ID NO: 2563 - DNA, 20 bp, Artificial Sequence
  Synthetic construct
agccatgcttcaaactccgg

SEQ ID NO: 2564 - DNA, 20 bp, Artificial Sequence
  Synthetic construct
gccatgcttcaaactccggt

SEQ ID NO: 2565 - DNA, 20 bp, Artificial Sequence
  Synthetic construct
ccatgcttcaaactccggtt

SEQ ID NO: 2566 - DNA, 20 bp, Artificial Sequence
  Synthetic construct
catgcttcaaactccggttg

SEQ ID NO: 2567 - DNA, 20 bp, Artificial Sequence
  Synthetic construct
atgcttcaaactccggttga

SEQ ID NO: 2568 - DNA, 20 bp, Artificial Sequence
  Synthetic construct
tgcttcaaactccggttgag

SEQ ID NO: 2569 - DNA, 20 bp, Artificial Sequence
  Synthetic construct
gcttcaaactccggttgagg

SEQ ID NO: 2570 - DNA, 20 bp, Artificial Sequence
  Synthetic construct
cttcaaactccggttgaggg

SEQ ID NO: 2571 - DNA, 20 bp, Artificial Sequence
  Synthetic construct
ttcaaactccggttgagggc

SEQ ID NO: 2572 - DNA, 20 bp, Artificial Sequence
  Synthetic construct
tcaaactccggttgagggct

SEQ ID NO: 2573 - DNA, 20 bp, Artificial Sequence
  Synthetic construct
caaactccggttgagggctc

SEQ ID NO: 2574 - DNA, 20 bp, Artificial Sequence
  Synthetic construct
aaactccggttgagggctct

SEQ ID NO: 2575 - DNA, 20 bp, Artificial Sequence
  Synthetic construct
aactccggttgagggctcta

SEQ ID NO: 2576 - DNA, 20 bp, Artificial Sequence
  Synthetic construct
actccggttgagggctctat

SEQ ID NO: 2577 - DNA, 20 bp, Artificial Sequence
  Synthetic construct
ctccggttgagggctctatc

SEQ ID NO: 2578 - DNA, 20 bp, Artificial Sequence
  Synthetic construct
tccggttgagggctctatct

SEQ ID NO: 2579 - DNA, 20 bp, Artificial Sequence
  Synthetic construct
ccggttgagggctctatcta

SEQ ID NO: 2580 - DNA, 20 bp, Artificial Sequence
  Synthetic construct
cggttgagggctctatctag

SEQ ID NO: 2581 - DNA, 20 bp, Artificial Sequence
  Synthetic construct
ggttgagggctctatctaga

SEQ ID NO: 2582 - DNA, 20 bp, Artificial Sequence
  Synthetic construct
gttgagggctctatctagag

SEQ ID NO: 2583 - DNA, 20 bp, Artificial Sequence
  Synthetic construct
ttgagggctctatctagaga

SEQ ID NO: 2584 - DNA, 20 bp, Artificial Sequence
  Synthetic construct
tgagggctctatctagagag

SEQ ID NO: 2585 - DNA, 20 bp, Artificial Sequence
  Synthetic construct
gagggctctatctagagagc

SEQ ID NO: 2586 - DNA, 20 bp, Artificial Sequence
  Synthetic construct
agggctctatctagagagcc

SEQ ID NO: 2587 - DNA, 20 bp, Artificial Sequence
  Synthetic construct
gggctctatctagagagccg

SEQ ID NO: 2588 - DNA, 20 bp, Artificial Sequence
  Synthetic construct
ggctctatctagagagccgt

SEQ ID NO: 2589 - DNA, 20 bp, Artificial Sequence
  Synthetic construct
gctctatctagagagccgtt

SEQ ID NO: 2590 - DNA, 20 bp, Artificial Sequence
  Synthetic construct
ctctatctagagagccgttg

SEQ ID NO: 2591 - DNA, 20 bp, Artificial Sequence
  Synthetic construct
tctatctagagagccgttgc

SEQ ID NO: 2592 - DNA, 20 bp, Artificial Sequence
  Synthetic construct
ctatctagagagccgttgcc

SEQ ID NO: 2593 - DNA, 20 bp, Artificial Sequence
  Synthetic construct
tatctagagagccgttgcct

SEQ ID NO: 2594 - DNA, 20 bp, Artificial Sequence
  Synthetic construct
atctagagagccgttgcctg

SEQ ID NO: 2595 - DNA, 20 bp, Artificial Sequence
  Synthetic construct
tctagagagccgttgcctga

SEQ ID NO: 2596 - DNA, 20 bp, Artificial Sequence
  Synthetic construct
ctagagagccgttgcctgat

SEQ ID NO: 2597 - DNA, 20 bp, Artificial Sequence
  Synthetic construct
tagagagccgttgcctgatt

SEQ ID NO: 2598 - DNA, 20 bp, Artificial Sequence
  Synthetic construct
agagagccgttgcctgatta

SEQ ID NO: 2599 - DNA, 20 bp, Artificial Sequence
  Synthetic construct
gagagccgttgcctgattaa

SEQ ID NO: 2600 - DNA, 20 bp, Artificial Sequence
  Synthetic construct
agagccgttgcctgattaat

SEQ ID NO: 2601 - DNA, 20 bp, Artificial Sequence
  Synthetic construct
gagccgttgcctgattaatg

SEQ ID NO: 2602 - DNA, 20 bp, Artificial Sequence
  Synthetic construct
agccgttgcctgattaatgc

SEQ ID NO: 2603 - DNA, 20 bp, Artificial Sequence
  Synthetic construct
gccgttgcctgattaatgct

SEQ ID NO: 2604 - DNA, 20 bp, Artificial Sequence
  Synthetic construct
ccgttgcctgattaatgcta

SEQ ID NO: 2605 - DNA, 20 bp, Artificial Sequence
  Synthetic construct
cgttgcctgattaatgctaa

SEQ ID NO: 2606 - DNA, 20 bp, Artificial Sequence
  Synthetic construct
gttgcctgattaatgctaac

SEQ ID NO: 2607 - DNA, 20 bp, Artificial Sequence
  Synthetic construct
ttgcctgattaatgctaacg

SEQ ID NO: 2608 - DNA, 20 bp, Artificial Sequence
  Synthetic construct
tgcctgattaatgctaacgc

SEQ ID NO: 2609 - DNA, 20 bp, Artificial Sequence
  Synthetic construct
gcctgattaatgctaacgca

SEQ ID NO: 2610 - DNA, 20 bp, Artificial Sequence
  Synthetic construct
cctgattaatgctaacgcat

SEQ ID NO: 2611 - DNA, 20 bp, Artificial Sequence
  Synthetic construct
ctgattaatgctaacgcatc

SEQ ID NO: 2612 - DNA, 20 bp, Artificial Sequence
  Synthetic construct
tgattaatgctaacgcatct

SEQ ID NO: 2613 - DNA, 20 bp, Artificial Sequence
  Synthetic construct
gattaatgctaacgcatcta

SEQ ID NO: 2614 - DNA, 20 bp, Artificial Sequence
  Synthetic construct
attaatgctaacgcatctaa

SEQ ID NO: 2615 - DNA, 20 bp, Artificial Sequence
  Synthetic construct
ttaatgctaacgcatctaag

SEQ ID NO: 2616 - DNA, 20 bp, Artificial Sequence
  Synthetic construct
taatgctaacgcatctaagg

SEQ ID NO: 2617 - DNA, 20 bp, Artificial Sequence
  Synthetic construct
aatgctaacgcatctaaggt

SEQ ID NO: 2618 - DNA, 20 bp, Artificial Sequence
  Synthetic construct
atgctaacgcatctaaggta

SEQ ID NO: 2619 - DNA, 20 bp, Artificial Sequence
  Synthetic construct
tgctaacgcatctaaggtat

SEQ ID NO: 2620 - DNA, 20 bp, Artificial Sequence
  Synthetic construct
gctaacgcatctaaggtatg

SEQ ID NO: 2621 - DNA, 20 bp, Artificial Sequence
  Synthetic construct
ctaacgcatctaaggtatgg

SEQ ID NO: 2622 - DNA, 20 bp, Artificial Sequence
  Synthetic construct
taacgcatctaaggtatgga

SEQ ID NO: 2623 - DNA, 20 bp, Artificial Sequence
  Synthetic construct
aacgcatctaaggtatggac

SEQ ID NO: 2624 - DNA, 20 bp, Artificial Sequence
  Synthetic construct
acgcatctaaggtatggacc

SEQ ID NO: 2625 - DNA, 20 bp, Artificial Sequence
  Synthetic construct
cgcatctaaggtatggacca

SEQ ID NO: 2626 - DNA, 20 bp, Artificial Sequence
  Synthetic construct
gcatctaaggtatggaccat

SEQ ID NO: 2627 - DNA, 20 bp, Artificial Sequence
  Synthetic construct
catctaaggtatggaccatc

SEQ ID NO: 2628 - DNA, 20 bp, Artificial Sequence
  Synthetic construct
atctaaggtatggaccatcg

SEQ ID NO: 2629 - DNA, 20 bp, Artificial Sequence
  Synthetic construct
tctaaggtatggaccatcga

SEQ ID NO: 2630 - DNA, 20 bp, Artificial Sequence
  Synthetic construct
ctaaggtatggaccatcgag

SEQ ID NO: 2631 - DNA, 20 bp, Artificial Sequence
  Synthetic construct
taaggtatggaccatcgaga

SEQ ID NO: 2632 - DNA, 20 bp, Artificial Sequence
  Synthetic construct
aaggtatggaccatcgagaa

SEQ ID NO: 2633 - DNA, 20 bp, Artificial Sequence
  Synthetic construct
aggtatggaccatcgagaaa

SEQ ID NO: 2634 - DNA, 20 bp, Artificial Sequence
  Synthetic construct
ggtatggaccatcgagaaag

SEQ ID NO: 2635 - DNA, 20 bp, Artificial Sequence
  Synthetic construct
gtatggaccatcgagaaagg

SEQ ID NO: 2636 - DNA, 20 bp, Artificial Sequence
  Synthetic construct
tatggaccatcgagaaagga

SEQ ID NO: 2637 - DNA, 20 bp, Artificial Sequence
  Synthetic construct
atggaccatcgagaaaggag

SEQ ID NO: 2638 - DNA, 20 bp, Artificial Sequence
  Synthetic construct
tggaccatcgagaaaggaga

SEQ ID NO: 2639 - DNA, 20 bp, Artificial Sequence
  Synthetic construct
ggaccatcgagaaaggagac

SEQ ID NO: 2640 - DNA, 20 bp, Artificial Sequence
  Synthetic construct
gaccatcgagaaaggagact

SEQ ID NO: 2641 - DNA, 20 bp, Artificial Sequence
  Synthetic construct
accatcgagaaaggagactt

SEQ ID NO: 2642 - DNA, 20 bp, Artificial Sequence
  Synthetic construct
ccatcgagaaaggagacttt

SEQ ID NO: 2643 - DNA, 20 bp, Artificial Sequence
  Synthetic construct
catcgagaaaggagacttta

SEQ ID NO: 2644 - DNA, 20 bp, Artificial Sequence
  Synthetic construct
atcgagaaaggagactttac

SEQ ID NO: 2645 - DNA, 20 bp, Artificial Sequence
  Synthetic construct
tcgagaaaggagactttacg

SEQ ID NO: 2646 - DNA, 20 bp, Artificial Sequence
  Synthetic construct
cgagaaaggagactttacgt

SEQ ID NO: 2647 - DNA, 20 bp, Artificial Sequence
  Synthetic construct
gagaaaggagactttacgta

SEQ ID NO: 2648 - DNA, 20 bp, Artificial Sequence
  Synthetic construct
agaaaggagactttacgtac

SEQ ID NO: 2649 - DNA, 20 bp, Artificial Sequence
  Synthetic construct
gaaaggagactttacgtacg

SEQ ID NO: 2650 - DNA, 20 bp, Artificial Sequence
  Synthetic construct
aaaggagactttacgtacgc

SEQ ID NO: 2651 - DNA, 20 bp, Artificial Sequence
  Synthetic construct
aaggagactttacgtacgcg

SEQ ID NO: 2652 - DNA, 20 bp, Artificial Sequence
  Synthetic construct
aggagactttacgtacgcgc

SEQ ID NO: 2653 - DNA, 20 bp, Artificial Sequence
  Synthetic construct
ggagactttacgtacgcgcc

SEQ ID NO: 2654 - DNA, 20 bp, Artificial Sequence
  Synthetic construct
gagactttacgtacgcgcca

SEQ ID NO: 2655 - DNA, 20 bp, Artificial Sequence
  Synthetic construct
agactttacgtacgcgccag

SEQ ID NO: 2656 - DNA, 20 bp, Artificial Sequence
  Synthetic construct
gactttacgtacgcgccagt

SEQ ID NO: 2657 - DNA, 20 bp, Artificial Sequence
  Synthetic construct
actttacgtacgcgccagtt

SEQ ID NO: 2658 - DNA, 20 bp, Artificial Sequence
  Synthetic construct
ctttacgtacgcgccagttg

SEQ ID NO: 2659 - DNA, 20 bp, Artificial Sequence
  Synthetic construct
tttacgtacgcgccagttgt

SEQ ID NO: 2660 - DNA, 20 bp, Artificial Sequence
  Synthetic construct
ttacgtacgcgccagttgtt

SEQ ID NO: 2661 - DNA, 20 bp, Artificial Sequence
  Synthetic construct
tacgtacgcgccagttgttg

SEQ ID NO: 2662 - DNA, 20 bp, Artificial Sequence
  Synthetic construct
acgtacgcgccagttgttgg

SEQ ID NO: 2663 - DNA, 20 bp, Artificial Sequence
  Synthetic construct
cgtacgcgccagttgttggc

SEQ ID NO: 2664 - DNA, 20 bp, Artificial Sequence
  Synthetic construct
gtacgcgccagttgttggcc

SEQ ID NO: 2665 - DNA, 20 bp, Artificial Sequence
  Synthetic construct
tacgcgccagttgttggcca

SEQ ID NO: 2666 - DNA, 20 bp, Artificial Sequence
  Synthetic construct
acgcgccagttgttggccat

SEQ ID NO: 2667 - DNA, 20 bp, Artificial Sequence
  Synthetic construct
cgcgccagttgttggccata

SEQ ID NO: 2668 - DNA, 20 bp, Artificial Sequence
  Synthetic construct
gcgccagttgttggccatac

SEQ ID NO: 2669 - DNA, 20 bp, Artificial Sequence
  Synthetic construct
cgccagttgttggccatacg

SEQ ID NO: 2670 - DNA, 20 bp, Artificial Sequence
  Synthetic construct
gccagttgttggccatacgg

SEQ ID NO: 2671 - DNA, 20 bp, Artificial Sequence
  Synthetic construct
ccagttgttggccatacgga

SEQ ID NO: 2672 - DNA, 20 bp, Artificial Sequence
  Synthetic construct
cagttgttggccatacggat

SEQ ID NO: 2673 - DNA, 20 bp, Artificial Sequence
  Synthetic construct
agttgttggccatacggatt

SEQ ID NO: 2674 - DNA, 20 bp, Artificial Sequence
  Synthetic construct
gttgttggccatacggattg

SEQ ID NO: 2675 - DNA, 20 bp, Artificial Sequence
  Synthetic construct
ttgttggccatacggattgt

SEQ ID NO: 2676 - DNA, 20 bp, Artificial Sequence
  Synthetic construct
tgttggccatacggattgta

SEQ ID NO: 2677 - DNA, 20 bp, Artificial Sequence
  Synthetic construct
gttggccatacggattgtac

SEQ ID NO: 2678 - DNA, 20 bp, Artificial Sequence
  Synthetic construct
ttggccatacggattgtacc

SEQ ID NO: 2679 - DNA, 20 bp, Artificial Sequence
  Synthetic construct
tggccatacggattgtaccc

SEQ ID NO: 2680 - DNA, 20 bp, Artificial Sequence
  Synthetic construct
ggccatacggattgtacccc

SEQ ID NO: 2681 - DNA, 20 bp, Artificial Sequence
  Synthetic construct
gccatacggattgtacccct

SEQ ID NO: 2682 - DNA, 20 bp, Artificial Sequence
  Synthetic construct
ccatacggattgtacccctc

SEQ ID NO: 2683 - DNA, 20 bp, Artificial Sequence
  Synthetic construct
catacggattgtacccctcg

SEQ ID NO: 2684 - DNA, 20 bp, Artificial Sequence
  Synthetic construct
atacggattgtacccctcga

SEQ ID NO: 2685 - DNA, 20 bp, Artificial Sequence
  Synthetic construct
tacggattgtacccctcgat

SEQ ID NO: 2686 - DNA, 20 bp, Artificial Sequence
  Synthetic construct
acggattgtacccctcgatg

SEQ ID NO: 2687 - DNA, 20 bp, Artificial Sequence
  Synthetic construct
cggattgtacccctcgatgc

SEQ ID NO: 2688 - DNA, 20 bp, Artificial Sequence
  Synthetic construct
ggattgtacccctcgatgca

SEQ ID NO: 2689 - DNA, 20 bp, Artificial Sequence
  Synthetic construct
gattgtacccctcgatgcat

SEQ ID NO: 2690 - DNA, 20 bp, Artificial Sequence
  Synthetic construct
attgtacccctcgatgcatg

SEQ ID NO: 2691 - DNA, 20 bp, Artificial Sequence
  Synthetic construct
ttgtacccctcgatgcatgg

SEQ ID NO: 2692 - DNA, 20 bp, Artificial Sequence
  Synthetic construct
tgtacccctcgatgcatggc

SEQ ID NO: 2693 - DNA, 20 bp, Artificial Sequence
  Synthetic construct
gtacccctcgatgcatggct

SEQ ID NO: 2694 - DNA, 20 bp, Artificial Sequence
  Synthetic construct
tacccctcgatgcatggctg

SEQ ID NO: 2695 - DNA, 20 bp, Artificial Sequence
  Synthetic construct
acccctcgatgcatggctga

SEQ ID NO: 2696 - DNA, 20 bp, Artificial Sequence
  Synthetic construct
cccctcgatgcatggctgag

SEQ ID NO: 2697 - DNA, 20 bp, Artificial Sequence
  Synthetic construct
ccctcgatgcatggctgaga

SEQ ID NO: 2698 - DNA, 20 bp, Artificial Sequence
  Synthetic construct
cctcgatgcatggctgagat

SEQ ID NO: 2699 - DNA, 20 bp, Artificial Sequence
  Synthetic construct
ctcgatgcatggctgagatt

SEQ ID NO: 2700 - DNA, 20 bp, Artificial Sequence
  Synthetic construct
tcgatgcatggctgagattt

SEQ ID NO: 2701 - DNA, 20 bp, Artificial Sequence
  Synthetic construct
cgatgcatggctgagatttg

SEQ ID NO: 2702 - DNA, 20 bp, Artificial Sequence
  Synthetic construct
gatgcatggctgagatttgg

SEQ ID NO: 2703 - DNA, 20 bp, Artificial Sequence
  Synthetic construct
atgcatggctgagatttggg

SEQ ID NO: 2704 - DNA, 20 bp, Artificial Sequence
  Synthetic construct
tgcatggctgagatttgggc

SEQ ID NO: 2705 - DNA, 20 bp, Artificial Sequence
  Synthetic construct
gcatggctgagatttgggcc

SEQ ID NO: 2706 - DNA, 20 bp, Artificial Sequence
  Synthetic construct
catggctgagatttgggcct

SEQ ID NO: 2707 - DNA, 20 bp, Artificial Sequence
  Synthetic construct
atggctgagatttgggcctt

SEQ ID NO: 2708 - DNA, 20 bp, Artificial Sequence
  Synthetic construct
tggctgagatttgggcctta

SEQ ID NO: 2709 - DNA, 20 bp, Artificial Sequence
  Synthetic construct
ggctgagatttgggccttag

SEQ ID NO: 2710 - DNA, 20 bp, Artificial Sequence
  Synthetic construct
gctgagatttgggccttagc

SEQ ID NO: 2711 - DNA, 20 bp, Artificial Sequence
  Synthetic construct
ctgagatttgggccttagca

SEQ ID NO: 2712 - DNA, 20 bp, Artificial Sequence
  Synthetic construct
tgagatttgggccttagcag

SEQ ID NO: 2713 - DNA, 20 bp, Artificial Sequence
  Synthetic construct
gagatttgggccttagcagt

SEQ ID NO: 2714 - DNA, 20 bp, Artificial Sequence
  Synthetic construct
agatttgggccttagcagtg

SEQ ID NO: 2715 - DNA, 20 bp, Artificial Sequence
  Synthetic construct
gatttgggccttagcagtgc

SEQ ID NO: 2716 - DNA, 20 bp, Artificial Sequence
  Synthetic construct
atttgggccttagcagtgcc

SEQ ID NO: 2717 - DNA, 20 bp, Artificial Sequence
  Synthetic construct
tttgggccttagcagtgccc

SEQ ID NO: 2718 - DNA, 20 bp, Artificial Sequence
  Synthetic construct
ttgggccttagcagtgccct

SEQ ID NO: 2719 - DNA, 20 bp, Artificial Sequence
  Synthetic construct
tgggccttagcagtgccctg

SEQ ID NO: 2720 - DNA, 20 bp, Artificial Sequence
  Synthetic construct
gggccttagcagtgccctgt

SEQ ID NO: 2721 - DNA, 20 bp, Artificial Sequence
  Synthetic construct
ggccttagcagtgccctgtc

SEQ ID NO: 2722 - DNA, 20 bp, Artificial Sequence
  Synthetic construct
gccttagcagtgccctgtct

SEQ ID NO: 2723 - DNA, 20 bp, Artificial Sequence
  Synthetic construct
ccttagcagtgccctgtctc

SEQ ID NO: 2724 - DNA, 20 bp, Artificial Sequence
  Synthetic construct
cttagcagtgccctgtctct

SEQ ID NO: 2725 - DNA, 20 bp, Artificial Sequence
  Synthetic construct
ttagcagtgccctgtctctc

SEQ ID NO: 2726 - DNA, 20 bp, Artificial Sequence
  Synthetic construct
tagcagtgccctgtctctcc

SEQ ID NO: 2727 - DNA, 20 bp, Artificial Sequence
  Synthetic construct
agcagtgccctgtctctcca

SEQ ID NO: 2728 - DNA, 20 bp, Artificial Sequence
  Synthetic construct
gcagtgccctgtctctccac

SEQ ID NO: 2729 - DNA, 20 bp, Artificial Sequence
  Synthetic construct
cagtgccctgtctctccaca

SEQ ID NO: 2730 - DNA, 20 bp, Artificial Sequence
  Synthetic construct
agtgccctgtctctccacag

SEQ ID NO: 2731 - DNA, 20 bp, Artificial Sequence
  Synthetic construct
gtgccctgtctctccacagt

SEQ ID NO: 2732 - DNA, 20 bp, Artificial Sequence
  Synthetic construct
tgccctgtctctccacagtc

SEQ ID NO: 2733 - DNA, 20 bp, Artificial Sequence
  Synthetic construct
gccctgtctctccacagtcc

SEQ ID NO: 2734 - DNA, 20 bp, Artificial Sequence
  Synthetic construct
ccctgtctctccacagtcca

SEQ ID NO: 2735 - DNA, 20 bp, Artificial Sequence
  Synthetic construct
cctgtctctccacagtccac

SEQ ID NO: 2736 - DNA, 20 bp, Artificial Sequence
  Synthetic construct
ctgtctctccacagtccacc

SEQ ID NO: 2737 - DNA, 20 bp, Artificial Sequence
  Synthetic construct
tgtctctccacagtccaccc

SEQ ID NO: 2738 - DNA, 20 bp, Artificial Sequence
  Synthetic construct
gtctctccacagtccacccg

SEQ ID NO: 2739 - DNA, 20 bp, Artificial Sequence
  Synthetic construct
tctctccacagtccacccgt

SEQ ID NO: 2740 - DNA, 20 bp, Artificial Sequence
  Synthetic construct
ctctccacagtccacccgta

SEQ ID NO: 2741 - DNA, 20 bp, Artificial Sequence
  Synthetic construct
tctccacagtccacccgtag

SEQ ID NO: 2742 - DNA, 20 bp, Artificial Sequence
  Synthetic construct
ctccacagtccacccgtagg

SEQ ID NO: 2743 - DNA, 20 bp, Artificial Sequence
  Synthetic construct
tccacagtccacccgtaggg

SEQ ID NO: 2744 - DNA, 20 bp, Artificial Sequence
  Synthetic construct
ccacagtccacccgtaggga

SEQ ID NO: 2745 - DNA, 20 bp, Artificial Sequence
  Synthetic construct
cacagtccacccgtagggag

SEQ ID NO: 2746 - DNA, 20 bp, Artificial Sequence
  Synthetic construct
acagtccacccgtagggagc

SEQ ID NO: 2747 - DNA, 20 bp, Artificial Sequence
  Synthetic construct
cagtccacccgtagggagcg

SEQ ID NO: 2748 - DNA, 20 bp, Artificial Sequence
  Synthetic construct
agtccacccgtagggagcgt

SEQ ID NO: 2749 - DNA, 20 bp, Artificial Sequence
  Synthetic construct
gtccacccgtagggagcgtc

SEQ ID NO: 2750 - DNA, 20 bp, Artificial Sequence
  Synthetic construct
tccacccgtagggagcgtca

SEQ ID NO: 2751 - DNA, 20 bp, Artificial Sequence
  Synthetic construct
ccacccgtagggagcgtcaa

SEQ ID NO: 2752 - DNA, 20 bp, Artificial Sequence
  Synthetic construct
cacccgtagggagcgtcaac

SEQ ID NO: 2753 - DNA, 20 bp, Artificial Sequence
  Synthetic construct
acccgtagggagcgtcaacg

SEQ ID NO: 2754 - DNA, 20 bp, Artificial Sequence
  Synthetic construct
cccgtagggagcgtcaacgc

SEQ ID NO: 2755 - DNA, 20 bp, Artificial Sequence
  Synthetic construct
ccgtagggagcgtcaacgct

SEQ ID NO: 2756 - DNA, 20 bp, Artificial Sequence
  Synthetic construct
cgtagggagcgtcaacgctt

SEQ ID NO: 2757 - DNA, 20 bp, Artificial Sequence
  Synthetic construct
gtagggagcgtcaacgctta

SEQ ID NO: 2758 - DNA, 20 bp, Artificial Sequence
  Synthetic construct
tagggagcgtcaacgcttat

SEQ ID NO: 2759 - DNA, 20 bp, Artificial Sequence
  Synthetic construct
agggagcgtcaacgcttatg

SEQ ID NO: 2760 - DNA, 20 bp, Artificial Sequence
  Synthetic construct
gggagcgtcaacgcttatga

SEQ ID NO: 2761 - DNA, 20 bp, Artificial Sequence
  Synthetic construct
ggagcgtcaacgcttatgat

SEQ ID NO: 2762 - DNA, 20 bp, Artificial Sequence
  Synthetic construct
gagcgtcaacgcttatgatg

SEQ ID NO: 2763 - DNA, 20 bp, Artificial Sequence
  Synthetic construct
agcgtcaacgcttatgatgg

SEQ ID NO: 2764 - DNA, 20 bp, Artificial Sequence
  Synthetic construct
gcgtcaacgcttatgatgga

SEQ ID NO: 2765 - DNA, 20 bp, Artificial Sequence
  Synthetic construct
cgtcaacgcttatgatggac

SEQ ID NO: 2766 - DNA, 20 bp, Artificial Sequence
  Synthetic construct
gtcaacgcttatgatggact

SEQ ID NO: 2767 - DNA, 20 bp, Artificial Sequence
  Synthetic construct
tcaacgcttatgatggactc

SEQ ID NO: 2768 - DNA, 20 bp, Artificial Sequence
  Synthetic construct
caacgcttatgatggactca

SEQ ID NO: 2769 - DNA, 20 bp, Artificial Sequence
  Synthetic construct
aacgcttatgatggactcac

SEQ ID NO: 2770 - DNA, 20 bp, Artificial Sequence
  Synthetic construct
acgcttatgatggactcacc

SEQ ID NO: 2771 - DNA, 20 bp, Artificial Sequence
  Synthetic construct
cgcttatgatggactcaccc

SEQ ID NO: 2772 - DNA, 20 bp, Artificial Sequence
  Synthetic construct
gcttatgatggactcacccg

SEQ ID NO: 2773 - DNA, 20 bp, Artificial Sequence
  Synthetic construct
cttatgatggactcacccgt

SEQ ID NO: 2774 - DNA, 20 bp, Artificial Sequence
  Synthetic construct
ttatgatggactcacccgtt

SEQ ID NO: 2775 - DNA, 20 bp, Artificial Sequence
  Synthetic construct
tatgatggactcacccgtta

SEQ ID NO: 2776 - DNA, 20 bp, Artificial Sequence
  Synthetic construct
atgatggactcacccgttat

SEQ ID NO: 2777 - DNA, 20 bp, Artificial Sequence
  Synthetic construct
tgatggactcacccgttatt

SEQ ID NO: 2778 - DNA, 20 bp, Artificial Sequence
  Synthetic construct
gatggactcacccgttatta

SEQ ID NO: 2779 - DNA, 20 bp, Artificial Sequence
  Synthetic construct
atggactcacccgttattac

SEQ ID NO: 2780 - DNA, 20 bp, Artificial Sequence
  Synthetic construct
tggactcacccgttattacg

SEQ ID NO: 2781 - DNA, 20 bp, Artificial Sequence
  Synthetic construct
ggactcacccgttattacgt

SEQ ID NO: 2782 - DNA, 20 bp, Artificial Sequence
  Synthetic construct
gactcacccgttattacgtc

SEQ ID NO: 2783 - DNA, 20 bp, Artificial Sequence
  Synthetic construct
actcacccgttattacgtca

SEQ ID NO: 2784 - DNA, 20 bp, Artificial Sequence
  Synthetic construct
ctcacccgttattacgtcag

SEQ ID NO: 2785 - DNA, 20 bp, Artificial Sequence
  Synthetic construct
tcacccgttattacgtcagt

SEQ ID NO: 2786 - DNA, 20 bp, Artificial Sequence
  Synthetic construct
cacccgttattacgtcagta

SEQ ID NO: 2787 - DNA, 20 bp, Artificial Sequence
  Synthetic construct
acccgttattacgtcagtaa

SEQ ID NO: 2788 - DNA, 20 bp, Artificial Sequence
  Synthetic construct
cccgttattacgtcagtaac

SEQ ID NO: 2789 - DNA, 20 bp, Artificial Sequence
  Synthetic construct
ccgttattacgtcagtaact

SEQ ID NO: 2790 - DNA, 20 bp, Artificial Sequence
  Synthetic construct
cgttattacgtcagtaactg

SEQ ID NO: 2791 - DNA, 20 bp, Artificial Sequence
  Synthetic construct
gttattacgtcagtaactgt

SEQ ID NO: 2792 - DNA, 20 bp, Artificial Sequence
  Synthetic construct
ttattacgtcagtaactgtt

SEQ ID NO: 2793 - DNA, 20 bp, Artificial Sequence
  Synthetic construct
tattacgtcagtaactgttc

SEQ ID NO: 2794 - DNA, 20 bp, Artificial Sequence
  Synthetic construct
attacgtcagtaactgttcc

SEQ ID NO: 2795 - DNA, 20 bp, Artificial Sequence
  Synthetic construct
ttacgtcagtaactgttcct

SEQ ID NO: 2796 - DNA, 20 bp, Artificial Sequence
  Synthetic construct
tacgtcagtaactgttcctg

SEQ ID NO: 2797 - DNA, 20 bp, Artificial Sequence
  Synthetic construct
acgtcagtaactgttcctga

SEQ ID NO: 2798 - DNA, 20 bp, Artificial Sequence
  Synthetic construct
cgtcagtaactgttcctgac

SEQ ID NO: 2799 - DNA, 20 bp, Artificial Sequence
  Synthetic construct
gtcagtaactgttcctgaca

SEQ ID NO: 2800 - DNA, 20 bp, Artificial Sequence
  Synthetic construct
tcagtaactgttcctgacat

SEQ ID NO: 2801 - DNA, 20 bp, Artificial Sequence
  Synthetic construct
cagtaactgttcctgacatg

SEQ ID NO: 2802 - DNA, 20 bp, Artificial Sequence
  Synthetic construct
agtaactgttcctgacatgt

SEQ ID NO: 2803 - DNA, 20 bp, Artificial Sequence
  Synthetic construct
gtaactgttcctgacatgta

SEQ ID NO: 2804 - DNA, 20 bp, Artificial Sequence
  Synthetic construct
taactgttcctgacatgtag

SEQ ID NO: 2805 - DNA, 20 bp, Artificial Sequence
  Synthetic construct
aactgttcctgacatgtagg

SEQ ID NO: 2806 - DNA, 20 bp, Artificial Sequence
  Synthetic construct
actgttcctgacatgtagga

SEQ ID NO: 2807 - DNA, 20 bp, Artificial Sequence
  Synthetic construct
ctgttcctgacatgtaggag

SEQ ID NO: 2808 - DNA, 20 bp, Artificial Sequence
  Synthetic construct
tgttcctgacatgtaggagc

SEQ ID NO: 2809 - DNA, 20 bp, Artificial Sequence
  Synthetic construct
gttcctgacatgtaggagca

SEQ ID NO: 2810 - DNA, 20 bp, Artificial Sequence
  Synthetic construct
ttcctgacatgtaggagcat

SEQ ID NO: 2811 - DNA, 20 bp, Artificial Sequence
  Synthetic construct
tcctgacatgtaggagcatc

SEQ ID NO: 2812 - DNA, 20 bp, Artificial Sequence
  Synthetic construct
cctgacatgtaggagcatcc

SEQ ID NO: 2813 - DNA, 20 bp, Artificial Sequence
  Synthetic construct
ctgacatgtaggagcatccc

SEQ ID NO: 2814 - DNA, 20 bp, Artificial Sequence
  Synthetic construct
tgacatgtaggagcatccca

SEQ ID NO: 2815 - DNA, 20 bp, Artificial Sequence
  Synthetic construct
gacatgtaggagcatcccac

SEQ ID NO: 2816 - DNA, 20 bp, Artificial Sequence
  Synthetic construct
acatgtaggagcatcccacg

SEQ ID NO: 2817 - DNA, 20 bp, Artificial Sequence
  Synthetic construct
catgtaggagcatcccacgg

SEQ ID NO: 2818 - DNA, 20 bp, Artificial Sequence
  Synthetic construct
atgtaggagcatcccacggg

SEQ ID NO: 2819 - DNA, 20 bp, Artificial Sequence
  Synthetic construct
tgtaggagcatcccacgggg

SEQ ID NO: 2820 - DNA, 20 bp, Artificial Sequence
  Synthetic construct
gtaggagcatcccacggggg

SEQ ID NO: 2821 - DNA, 20 bp, Artificial Sequence
  Synthetic construct
taggagcatcccacgggggc

SEQ ID NO: 2822 - DNA, 20 bp, Artificial Sequence
  Synthetic construct
aggagcatcccacgggggcc

SEQ ID NO: 2823 - DNA, 20 bp, Artificial Sequence
  Synthetic construct
ggagcatcccacgggggccg

SEQ ID NO: 2824 - DNA, 20 bp, Artificial Sequence
  Synthetic construct
gagcatcccacgggggccgt

SEQ ID NO: 2825 - DNA, 20 bp, Artificial Sequence
  Synthetic construct
agcatcccacgggggccgta

SEQ ID NO: 2826 - DNA, 20 bp, Artificial Sequence
  Synthetic construct
gcatcccacgggggccgtaa

SEQ ID NO: 2827 - DNA, 20 bp, Artificial Sequence
  Synthetic construct
catcccacgggggccgtaag

SEQ ID NO: 2828 - DNA, 20 bp, Artificial Sequence
  Synthetic construct
atcccacgggggccgtaagg

SEQ ID NO: 2829 - DNA, 20 bp, Artificial Sequence
  Synthetic construct
tcccacgggggccgtaaggc

SEQ ID NO: 2830 - DNA, 20 bp, Artificial Sequence
  Synthetic construct
cccacgggggccgtaaggcc

SEQ ID NO: 2831 - DNA, 20 bp, Artificial Sequence
  Synthetic construct
ccacgggggccgtaaggccc

SEQ ID NO: 2832 - DNA, 20 bp, Artificial Sequence
  Synthetic construct
cacgggggccgtaaggccct

SEQ ID NO: 2833 - DNA, 20 bp, Artificial Sequence
  Synthetic construct
acgggggccgtaaggccctc

SEQ ID NO: 2834 - DNA, 20 bp, Artificial Sequence
  Synthetic construct
cgggggccgtaaggccctcg

SEQ ID NO: 2835 - DNA, 20 bp, Artificial Sequence
  Synthetic construct
gggggccgtaaggccctcga

SEQ ID NO: 2836 - DNA, 20 bp, Artificial Sequence
  Synthetic construct
ggggccgtaaggccctcgag

SEQ ID NO: 2837 - DNA, 20 bp, Artificial Sequence
  Synthetic construct
gggccgtaaggccctcgagc

SEQ ID NO: 2838 - DNA, 20 bp, Artificial Sequence
  Synthetic construct
ggccgtaaggccctcgagca

SEQ ID NO: 2839 - DNA, 20 bp, Artificial Sequence
  Synthetic construct
gccgtaaggccctcgagcat

SEQ ID NO: 2840 - DNA, 20 bp, Artificial Sequence
  Synthetic construct
ccgtaaggccctcgagcatg

SEQ ID NO: 2841 - DNA, 20 bp, Artificial Sequence
  Synthetic construct
cgtaaggccctcgagcatgt

SEQ ID NO: 2842 - DNA, 20 bp, Artificial Sequence
  Synthetic construct
gtaaggccctcgagcatgtt

SEQ ID NO: 2843 - DNA, 20 bp, Artificial Sequence
  Synthetic construct
taaggccctcgagcatgtta

SEQ ID NO: 2844 - DNA, 20 bp, Artificial Sequence
  Synthetic construct
aaggccctcgagcatgttac

SEQ ID NO: 2845 - DNA, 20 bp, Artificial Sequence
  Synthetic construct
aggccctcgagcatgttacc

SEQ ID NO: 2846 - DNA, 20 bp, Artificial Sequence
  Synthetic construct
ggccctcgagcatgttacct

SEQ ID NO: 2847 - DNA, 20 bp, Artificial Sequence
  Synthetic construct
gccctcgagcatgttaccta

SEQ ID NO: 2848 - DNA, 20 bp, Artificial Sequence
  Synthetic construct
ccctcgagcatgttacctac

SEQ ID NO: 2849 - DNA, 20 bp, Artificial Sequence
  Synthetic construct
cctcgagcatgttacctaca

SEQ ID NO: 2850 - DNA, 20 bp, Artificial Sequence
  Synthetic construct
ctcgagcatgttacctacag

SEQ ID NO: 2851 - DNA, 20 bp, Artificial Sequence
  Synthetic construct
tcgagcatgttacctacagg

SEQ ID NO: 2852 - DNA, 20 bp, Artificial Sequence
  Synthetic construct
cgagcatgttacctacaggt

SEQ ID NO: 2853 - DNA, 20 bp, Artificial Sequence
  Synthetic construct
gagcatgttacctacaggta

SEQ ID NO: 2854 - DNA, 20 bp, Artificial Sequence
  Synthetic construct
agcatgttacctacaggtag

SEQ ID NO: 2855 - DNA, 20 bp, Artificial Sequence
  Synthetic construct
gcatgttacctacaggtagg

SEQ ID NO: 2856 - DNA, 20 bp, Artificial Sequence
  Synthetic construct
catgttacctacaggtagga

SEQ ID NO: 2857 - DNA, 20 bp, Artificial Sequence
  Synthetic construct
atgttacctacaggtaggag

SEQ ID NO: 2858 - DNA, 20 bp, Artificial Sequence
  Synthetic construct
tgttacctacaggtaggagc

SEQ ID NO: 2859 - DNA, 20 bp, Artificial Sequence
  Synthetic construct
gttacctacaggtaggagcc

SEQ ID NO: 2860 - DNA, 20 bp, Artificial Sequence
  Synthetic construct
ttacctacaggtaggagcca

SEQ ID NO: 2861 - DNA, 20 bp, Artificial Sequence
  Synthetic construct
tacctacaggtaggagccag

SEQ ID NO: 2862 - DNA, 20 bp, Artificial Sequence
  Synthetic construct
acctacaggtaggagccagt

SEQ ID NO: 2863 - DNA, 20 bp, Artificial Sequence
  Synthetic construct
cctacaggtaggagccagtc

SEQ ID NO: 2864 - DNA, 20 bp, Artificial Sequence
  Synthetic construct
ctacaggtaggagccagtcg

SEQ ID NO: 2865 - DNA, 20 bp, Artificial Sequence
  Synthetic construct
tacaggtaggagccagtcga

SEQ ID NO: 2866 - DNA, 20 bp, Artificial Sequence
  Synthetic construct
acaggtaggagccagtcgac

SEQ ID NO: 2867 - DNA, 20 bp, Artificial Sequence
  Synthetic construct
caggtaggagccagtcgaca

SEQ ID NO: 2868 - DNA, 20 bp, Artificial Sequence
  Synthetic construct
aggtaggagccagtcgacaa

SEQ ID NO: 2869 - DNA, 20 bp, Artificial Sequence
  Synthetic construct
ggtaggagccagtcgacaac

SEQ ID NO: 2870 - DNA, 20 bp, Artificial Sequence
  Synthetic construct
gtaggagccagtcgacaacg

SEQ ID NO: 2871 - DNA, 20 bp, Artificial Sequence
  Synthetic construct
taggagccagtcgacaacga

SEQ ID NO: 2872 - DNA, 20 bp, Artificial Sequence
  Synthetic construct
aggagccagtcgacaacgaa

SEQ ID NO: 2873 - DNA, 20 bp, Artificial Sequence
  Synthetic construct
ggagccagtcgacaacgaat

SEQ ID NO: 2874 - DNA, 20 bp, Artificial Sequence
  Synthetic construct
gagccagtcgacaacgaatg

SEQ ID NO: 2875 - DNA, 20 bp, Artificial Sequence
  Synthetic construct
agccagtcgacaacgaatga

SEQ ID NO: 2876 - DNA, 20 bp, Artificial Sequence
  Synthetic construct
gccagtcgacaacgaatgag

SEQ ID NO: 2877 - DNA, 20 bp, Artificial Sequence
  Synthetic construct
ccagtcgacaacgaatgaga

SEQ ID NO: 2878 - DNA, 20 bp, Artificial Sequence
  Synthetic construct
cagtcgacaacgaatgagaa

SEQ ID NO: 2879 - DNA, 20 bp, Artificial Sequence
  Synthetic construct
agtcgacaacgaatgagaaa

SEQ ID NO: 2880 - DNA, 20 bp, Artificial Sequence
  Synthetic construct
gtcgacaacgaatgagaaag

SEQ ID NO: 2881 - DNA, 20 bp, Artificial Sequence
  Synthetic construct
tcgacaacgaatgagaaagg

SEQ ID NO: 2882 - DNA, 20 bp, Artificial Sequence
  Synthetic construct
cgacaacgaatgagaaaggc

SEQ ID NO: 2883 - DNA, 20 bp, Artificial Sequence
  Synthetic construct
gacaacgaatgagaaaggca

SEQ ID NO: 2884 - DNA, 20 bp, Artificial Sequence
  Synthetic construct
acaacgaatgagaaaggcac

SEQ ID NO: 2885 - DNA, 20 bp, Artificial Sequence
  Synthetic construct
caacgaatgagaaaggcacc

SEQ ID NO: 2886 - DNA, 20 bp, Artificial Sequence
  Synthetic construct
aacgaatgagaaaggcacct

SEQ ID NO: 2887 - DNA, 20 bp, Artificial Sequence
  Synthetic construct
acgaatgagaaaggcacctt

SEQ ID NO: 2888 - DNA, 20 bp, Artificial Sequence
  Synthetic construct
cgaatgagaaaggcaccttt

SEQ ID NO: 2889 - DNA, 20 bp, Artificial Sequence
  Synthetic construct
gaatgagaaaggcacctttt

SEQ ID NO: 2890 - DNA, 20 bp, Artificial Sequence
  Synthetic construct
aatgagaaaggcaccttttc

SEQ ID NO: 2891 - DNA, 20 bp, Artificial Sequence
  Synthetic construct
atgagaaaggcaccttttcc

SEQ ID NO: 2892 - DNA, 20 bp, Artificial Sequence
  Synthetic construct
tgagaaaggcaccttttccc

SEQ ID NO: 2893 - DNA, 20 bp, Artificial Sequence
  Synthetic construct
gagaaaggcaccttttccca

SEQ ID NO: 2894 - DNA, 20 bp, Artificial Sequence
  Synthetic construct
agaaaggcaccttttcccac

SEQ ID NO: 2895 - DNA, 20 bp, Artificial Sequence
  Synthetic construct
gaaaggcaccttttcccaca

SEQ ID NO: 2896 - DNA, 20 bp, Artificial Sequence
  Synthetic construct
aaaggcaccttttcccacac

SEQ ID NO: 2897 - DNA, 20 bp, Artificial Sequence
  Synthetic construct
aaggcaccttttcccacact

SEQ ID NO: 2898 - DNA, 20 bp, Artificial Sequence
  Synthetic construct
aggcaccttttcccacacta

SEQ ID NO: 2899 - DNA, 20 bp, Artificial Sequence
  Synthetic construct
ggcaccttttcccacactat

SEQ ID NO: 2900 - DNA, 20 bp, Artificial Sequence
  Synthetic construct
gcaccttttcccacactata

SEQ ID NO: 2901 - DNA, 20 bp, Artificial Sequence
  Synthetic construct
caccttttcccacactatac

SEQ ID NO: 2902 - DNA, 20 bp, Artificial Sequence
  Synthetic construct
accttttcccacactatacc

SEQ ID NO: 2903 - DNA, 20 bp, Artificial Sequence
  Synthetic construct
ccttttcccacactatacct

SEQ ID NO: 2904 - DNA, 20 bp, Artificial Sequence
  Synthetic construct
cttttcccacactataccta

SEQ ID NO: 2905 - DNA, 20 bp, Artificial Sequence
  Synthetic construct
ttttcccacactatacctag

SEQ ID NO: 2906 - DNA, 20 bp, Artificial Sequence
  Synthetic construct
tttcccacactatacctagt

SEQ ID NO: 2907 - DNA, 20 bp, Artificial Sequence
  Synthetic construct
ttcccacactatacctagtg

SEQ ID NO: 2908 - DNA, 20 bp, Artificial Sequence
  Synthetic construct
tcccacactatacctagtgg

SEQ ID NO: 2909 - DNA, 20 bp, Artificial Sequence
  Synthetic construct
cccacactatacctagtggg

SEQ ID NO: 2910 - DNA, 20 bp, Artificial Sequence
  Synthetic construct
ccacactatacctagtgggt

SEQ ID NO: 2911 - DNA, 20 bp, Artificial Sequence
  Synthetic construct
cacactatacctagtgggtt

SEQ ID NO: 2912 - DNA, 20 bp, Artificial Sequence
  Synthetic construct
acactatacctagtgggttc

SEQ ID NO: 2913 - DNA, 20 bp, Artificial Sequence
  Synthetic construct
cactatacctagtgggttca

SEQ ID NO: 2914 - DNA, 20 bp, Artificial Sequence
  Synthetic construct
actatacctagtgggttcaa

SEQ ID NO: 2915 - DNA, 20 bp, Artificial Sequence
  Synthetic construct
ctatacctagtgggttcaag

SEQ ID NO: 2916 - DNA, 20 bp, Artificial Sequence
  Synthetic construct
tatacctagtgggttcaaga

SEQ ID NO: 2917 - DNA, 20 bp, Artificial Sequence
  Synthetic construct
atacctagtgggttcaagat

SEQ ID NO: 2918 - DNA, 20 bp, Artificial Sequence
  Synthetic construct
tacctagtgggttcaagata

SEQ ID NO: 2919 - DNA, 20 bp, Artificial Sequence
  Synthetic construct
acctagtgggttcaagatac

SEQ ID NO: 2920 - DNA, 20 bp, Artificial Sequence
  Synthetic construct
cctagtgggttcaagatacc

SEQ ID NO: 2921 - DNA, 20 bp, Artificial Sequence
  Synthetic construct
ctagtgggttcaagatacct

SEQ ID NO: 2922 - DNA, 20 bp, Artificial Sequence
  Synthetic construct
tagtgggttcaagataccta

SEQ ID NO: 2923 - DNA, 20 bp, Artificial Sequence
  Synthetic construct
agtgggttcaagatacctag

SEQ ID NO: 2924 - DNA, 20 bp, Artificial Sequence
  Synthetic construct
gtgggttcaagatacctaga

SEQ ID NO: 2925 - DNA, 20 bp, Artificial Sequence
  Synthetic construct
tgggttcaagatacctagag

SEQ ID NO: 2926 - DNA, 20 bp, Artificial Sequence
  Synthetic construct
gggttcaagatacctagaga

SEQ ID NO: 2927 - DNA, 20 bp, Artificial Sequence
  Synthetic construct
ggttcaagatacctagagac

SEQ ID NO: 2928 - DNA, 20 bp, Artificial Sequence
  Synthetic construct
gttcaagatacctagagacg

SEQ ID NO: 2929 - DNA, 20 bp, Artificial Sequence
  Synthetic construct
ttcaagatacctagagacga

SEQ ID NO: 2930 - DNA, 20 bp, Artificial Sequence
  Synthetic construct
tcaagatacctagagacgac

SEQ ID NO: 2931 - DNA, 20 bp, Artificial Sequence
  Synthetic construct
caagatacctagagacgaca

SEQ ID NO: 2932 - DNA, 20 bp, Artificial Sequence
  Synthetic construct
aagatacctagagacgacaa

SEQ ID NO: 2933 - DNA, 20 bp, Artificial Sequence
  Synthetic construct
agatacctagagacgacaac

SEQ ID NO: 2934 - DNA, 20 bp, Artificial Sequence
  Synthetic construct
gatacctagagacgacaacc

SEQ ID NO: 2935 - DNA, 20 bp, Artificial Sequence
  Synthetic construct
atacctagagacgacaacca

SEQ ID NO: 2936 - DNA, 20 bp, Artificial Sequence
  Synthetic construct
tacctagagacgacaaccat

SEQ ID NO: 2937 - DNA, 20 bp, Artificial Sequence
  Synthetic construct
acctagagacgacaaccatg

SEQ ID NO: 2938 - DNA, 20 bp, Artificial Sequence
  Synthetic construct
cctagagacgacaaccatgc

SEQ ID NO: 2939 - DNA, 20 bp, Artificial Sequence
  Synthetic construct
ctagagacgacaaccatgcc

SEQ ID NO: 2940 - DNA, 20 bp, Artificial Sequence
  Synthetic construct
tagagacgacaaccatgcca

SEQ ID NO: 2941 - DNA, 20 bp, Artificial Sequence
  Synthetic construct
agagacgacaaccatgccaa

SEQ ID NO: 2942 - DNA, 20 bp, Artificial Sequence
  Synthetic construct
gagacgacaaccatgccaaa

SEQ ID NO: 2943 - DNA, 20 bp, Artificial Sequence
  Synthetic construct
agacgacaaccatgccaaac

SEQ ID NO: 2944 - DNA, 20 bp, Artificial Sequence
  Synthetic construct
gacgacaaccatgccaaacg

SEQ ID NO: 2945 - DNA, 20 bp, Artificial Sequence
  Synthetic construct
acgacaaccatgccaaacgt

SEQ ID NO: 2946 - DNA, 20 bp, Artificial Sequence
  Synthetic construct
cgacaaccatgccaaacgtg

SEQ ID NO: 2947 - DNA, 20 bp, Artificial Sequence
  Synthetic construct
gacaaccatgccaaacgtgc

SEQ ID NO: 2948 - DNA, 20 bp, Artificial Sequence
  Synthetic construct
acaaccatgccaaacgtgca

SEQ ID NO: 2949 - DNA, 20 bp, Artificial Sequence
  Synthetic construct
caaccatgccaaacgtgcat

SEQ ID NO: 2950 - DNA, 20 bp, Artificial Sequence
  Synthetic construct
aaccatgccaaacgtgcatc

SEQ ID NO: 2951 - DNA, 20 bp, Artificial Sequence
  Synthetic construct
accatgccaaacgtgcatcg

SEQ ID NO: 2952 - DNA, 20 bp, Artificial Sequence
  Synthetic construct
ccatgccaaacgtgcatcgt

SEQ ID NO: 2953 - DNA, 20 bp, Artificial Sequence
  Synthetic construct
catgccaaacgtgcatcgtt

SEQ ID NO: 2954 - DNA, 20 bp, Artificial Sequence
  Synthetic construct
atgccaaacgtgcatcgttt

SEQ ID NO: 2955 - DNA, 20 bp, Artificial Sequence
  Synthetic construct
tgccaaacgtgcatcgttta

SEQ ID NO: 2956 - DNA, 20 bp, Artificial Sequence
  Synthetic construct
gccaaacgtgcatcgtttat

SEQ ID NO: 2957 - DNA, 20 bp, Artificial Sequence
  Synthetic construct
ccaaacgtgcatcgtttatg

SEQ ID NO: 2958 - DNA, 20 bp, Artificial Sequence
  Synthetic construct
caaacgtgcatcgtttatgt

SEQ ID NO: 2959 - DNA, 20 bp, Artificial Sequence
  Synthetic construct
aaacgtgcatcgtttatgta

SEQ ID NO: 2960 - DNA, 20 bp, Artificial Sequence
  Synthetic construct
aacgtgcatcgtttatgtaa

SEQ ID NO: 2961 - DNA, 20 bp, Artificial Sequence
  Synthetic construct
acgtgcatcgtttatgtaaa

SEQ ID NO: 2962 - DNA, 20 bp, Artificial Sequence
  Synthetic construct
cgtgcatcgtttatgtaaaa

SEQ ID NO: 2963 - DNA, 20 bp, Artificial Sequence
  Synthetic construct
gtgcatcgtttatgtaaaac

SEQ ID NO: 2964 - DNA, 20 bp, Artificial Sequence
  Synthetic construct
tgcatcgtttatgtaaaacc

SEQ ID NO: 2965 - DNA, 20 bp, Artificial Sequence
  Synthetic construct
gcatcgtttatgtaaaacca

SEQ ID NO: 2966 - DNA, 20 bp, Artificial Sequence
  Synthetic construct
catcgtttatgtaaaaccat

SEQ ID NO: 2967 - DNA, 20 bp, Artificial Sequence
  Synthetic construct
atcgtttatgtaaaaccata

SEQ ID NO: 2968 - DNA, 20 bp, Artificial Sequence
  Synthetic construct
tcgtttatgtaaaaccatat

SEQ ID NO: 2969 - DNA, 20 bp, Artificial Sequence
  Synthetic construct
cgtttatgtaaaaccatatc

SEQ ID NO: 2970 - DNA, 20 bp, Artificial Sequence
  Synthetic construct
gtttatgtaaaaccatatca

SEQ ID NO: 2971 - DNA, 20 bp, Artificial Sequence
  Synthetic construct
tttatgtaaaaccatatcac

SEQ ID NO: 2972 - DNA, 20 bp, Artificial Sequence
  Synthetic construct
ttatgtaaaaccatatcacg

SEQ ID NO: 2973 - DNA, 20 bp, Artificial Sequence
  Synthetic construct
tatgtaaaaccatatcacga

SEQ ID NO: 2974 - DNA, 20 bp, Artificial Sequence
  Synthetic construct
atgtaaaaccatatcacgat

SEQ ID NO: 2975 - DNA, 20 bp, Artificial Sequence
  Synthetic construct
tgtaaaaccatatcacgata

SEQ ID NO: 2976 - DNA, 20 bp, Artificial Sequence
  Synthetic construct
gtaaaaccatatcacgatac

SEQ ID NO: 2977 - DNA, 20 bp, Artificial Sequence
  Synthetic construct
taaaaccatatcacgatacg

SEQ ID NO: 2978 - DNA, 20 bp, Artificial Sequence
  Synthetic construct
aaaaccatatcacgatacgt

SEQ ID NO: 2979 - DNA, 20 bp, Artificial Sequence
  Synthetic construct
aaaccatatcacgatacgtc

SEQ ID NO: 2980 - DNA, 20 bp, Artificial Sequence
  Synthetic construct
aaccatatcacgatacgtcg

SEQ ID NO: 2981 - DNA, 20 bp, Artificial Sequence
  Synthetic construct
accatatcacgatacgtcgc

SEQ ID NO: 2982 - DNA, 20 bp, Artificial Sequence
  Synthetic construct
ccatatcacgatacgtcgcg

SEQ ID NO: 2983 - DNA, 20 bp, Artificial Sequence
  Synthetic construct
catatcacgatacgtcgcga

SEQ ID NO: 2984 - DNA, 20 bp, Artificial Sequence
  Synthetic construct
atatcacgatacgtcgcgat

SEQ ID NO: 2985 - DNA, 20 bp, Artificial Sequence
  Synthetic construct
tatcacgatacgtcgcgata

SEQ ID NO: 2986 - DNA, 20 bp, Artificial Sequence
  Synthetic construct
atcacgatacgtcgcgatat

SEQ ID NO: 2987 - DNA, 20 bp, Artificial Sequence
  Synthetic construct
tcacgatacgtcgcgatatg

SEQ ID NO: 2988 - DNA, 20 bp, Artificial Sequence
  Synthetic construct
cacgatacgtcgcgatatgt

SEQ ID NO: 2989 - DNA, 20 bp, Artificial Sequence
  Synthetic construct
acgatacgtcgcgatatgtt

SEQ ID NO: 2990 - DNA, 20 bp, Artificial Sequence
  Synthetic construct
cgatacgtcgcgatatgttg

SEQ ID NO: 2991 - DNA, 20 bp, Artificial Sequence
  Synthetic construct
gatacgtcgcgatatgttgc

SEQ ID NO: 2992 - DNA, 20 bp, Artificial Sequence
  Synthetic construct
atacgtcgcgatatgttgca

SEQ ID NO: 2993 - DNA, 20 bp, Artificial Sequence
  Synthetic construct
tacgtcgcgatatgttgcac

SEQ ID NO: 2994 - DNA, 20 bp, Artificial Sequence
  Synthetic construct
acgtcgcgatatgttgcacg

SEQ ID NO: 2995 - DNA, 20 bp, Artificial Sequence
  Synthetic construct
cgtcgcgatatgttgcacgt

SEQ ID NO: 2996 - DNA, 20 bp, Artificial Sequence
  Synthetic construct
gtcgcgatatgttgcacgtt

SEQ ID NO: 2997 - DNA, 20 bp, Artificial Sequence
  Synthetic construct
tcgcgatatgttgcacgttg

SEQ ID NO: 2998 - DNA, 20 bp, Artificial Sequence
  Synthetic construct
cgcgatatgttgcacgttgt

SEQ ID NO: 2999 - DNA, 20 bp, Artificial Sequence
  Synthetic construct
gcgatatgttgcacgttgtc

SEQ ID NO: 3000 - DNA, 20 bp, Artificial Sequence
  Synthetic construct
cgatatgttgcacgttgtct

SEQ ID NO: 3001 - DNA, 20 bp, Artificial Sequence
  Synthetic construct
gatatgttgcacgttgtctg

SEQ ID NO: 3002 - DNA, 20 bp, Artificial Sequence
  Synthetic construct
atatgttgcacgttgtctgg

SEQ ID NO: 3003 - DNA, 20 bp, Artificial Sequence
  Synthetic construct
tatgttgcacgttgtctgga

SEQ ID NO: 3004 - DNA, 20 bp, Artificial Sequence
  Synthetic construct
atgttgcacgttgtctggaa

SEQ ID NO: 3005 - DNA, 20 bp, Artificial Sequence
  Synthetic construct
tgttgcacgttgtctggaag

SEQ ID NO: 3006 - DNA, 20 bp, Artificial Sequence
  Synthetic construct
gttgcacgttgtctggaagt

SEQ ID NO: 3007 - DNA, 20 bp, Artificial Sequence
  Synthetic construct
ttgcacgttgtctggaagtt

SEQ ID NO: 3008 - DNA, 20 bp, Artificial Sequence
  Synthetic construct
tgcacgttgtctggaagttt

SEQ ID NO: 3009 - DNA, 20 bp, Artificial Sequence
  Synthetic construct
gcacgttgtctggaagtttg

SEQ ID NO: 3010 - DNA, 20 bp, Artificial Sequence
  Synthetic construct
cacgttgtctggaagtttgc

SEQ ID NO: 3011 - DNA, 20 bp, Artificial Sequence
  Synthetic construct
acgttgtctggaagtttgca

SEQ ID NO: 3012 - DNA, 20 bp, Artificial Sequence
  Synthetic construct
cgttgtctggaagtttgcag

SEQ ID NO: 3013 - DNA, 20 bp, Artificial Sequence
  Synthetic construct
gttgtctggaagtttgcagc

SEQ ID NO: 3014 - DNA, 20 bp, Artificial Sequence
  Synthetic construct
ttgtctggaagtttgcagct

SEQ ID NO: 3015 - DNA, 20 bp, Artificial Sequence
  Synthetic construct
tgtctggaagtttgcagctg

SEQ ID NO: 3016 - DNA, 20 bp, Artificial Sequence
  Synthetic construct
gtctggaagtttgcagctgg

SEQ ID NO: 3017 - DNA, 20 bp, Artificial Sequence
  Synthetic construct
tctggaagtttgcagctgga

SEQ ID NO: 3018 - DNA, 20 bp, Artificial Sequence
  Synthetic construct
ctggaagtttgcagctggat

SEQ ID NO: 3019 - DNA, 20 bp, Artificial Sequence
  Synthetic construct
tggaagtttgcagctggata

SEQ ID NO: 3020 - DNA, 20 bp, Artificial Sequence
  Synthetic construct
ggaagtttgcagctggatac

SEQ ID NO: 3021 - DNA, 20 bp, Artificial Sequence
  Synthetic construct
gaagtttgcagctggatacg

SEQ ID NO: 3022 - DNA, 20 bp, Artificial Sequence
  Synthetic construct
aagtttgcagctggatacga

SEQ ID NO: 3023 - DNA, 20 bp, Artificial Sequence
  Synthetic construct
agtttgcagctggatacgac

SEQ ID NO: 3024 - DNA, 20 bp, Artificial Sequence
  Synthetic construct
gtttgcagctggatacgaca

SEQ ID NO: 3025 - DNA, 20 bp, Artificial Sequence
  Synthetic construct
tttgcagctggatacgacag

SEQ ID NO: 3026 - DNA, 20 bp, Artificial Sequence
  Synthetic construct
ttgcagctggatacgacaga

SEQ ID NO: 3027 - DNA, 20 bp, Artificial Sequence
  Synthetic construct
tgcagctggatacgacagac

SEQ ID NO: 3028 - DNA, 20 bp, Artificial Sequence
  Synthetic construct
gcagctggatacgacagacg

SEQ ID NO: 3029 - DNA, 20 bp, Artificial Sequence
  Synthetic construct
cagctggatacgacagacgg

SEQ ID NO: 3030 - DNA, 20 bp, Artificial Sequence
  Synthetic construct
agctggatacgacagacggc

SEQ ID NO: 3031 - DNA, 20 bp, Artificial Sequence
  Synthetic construct
gctggatacgacagacggcc

SEQ ID NO: 3032 - DNA, 20 bp, Artificial Sequence
  Synthetic construct
ctggatacgacagacggcca

SEQ ID NO: 3033 - DNA, 20 bp, Artificial Sequence
  Synthetic construct
tggatacgacagacggccat

SEQ ID NO: 3034 - DNA, 20 bp, Artificial Sequence
  Synthetic construct
ggatacgacagacggccatc

SEQ ID NO: 3035 - DNA, 20 bp, Artificial Sequence
  Synthetic construct
gatacgacagacggccatct

SEQ ID NO: 3036 - DNA, 20 bp, Artificial Sequence
  Synthetic construct
atacgacagacggccatcta

SEQ ID NO: 3037 - DNA, 20 bp, Artificial Sequence
  Synthetic construct
tacgacagacggccatctaa

SEQ ID NO: 3038 - DNA, 20 bp, Artificial Sequence
  Synthetic construct
acgacagacggccatctaac

SEQ ID NO: 3039 - DNA, 20 bp, Artificial Sequence
  Synthetic construct
cgacagacggccatctaact

SEQ ID NO: 3040 - DNA, 20 bp, Artificial Sequence
  Synthetic construct
gacagacggccatctaactt

SEQ ID NO: 3041 - DNA, 20 bp, Artificial Sequence
  Synthetic construct
acagacggccatctaacttg

SEQ ID NO: 3042 - DNA, 20 bp, Artificial Sequence
  Synthetic construct
cagacggccatctaacttga

SEQ ID NO: 3043 - DNA, 20 bp, Artificial Sequence
  Synthetic construct
agacggccatctaacttgat

SEQ ID NO: 3044 - DNA, 20 bp, Artificial Sequence
  Synthetic construct
gacggccatctaacttgatg

SEQ ID NO: 3045 - DNA, 20 bp, Artificial Sequence
  Synthetic construct
acggccatctaacttgatgt

SEQ ID NO: 3046 - DNA, 20 bp, Artificial Sequence
  Synthetic construct
cggccatctaacttgatgtt

SEQ ID NO: 3047 - DNA, 20 bp, Artificial Sequence
  Synthetic construct
ggccatctaacttgatgtta

SEQ ID NO: 3048 - DNA, 20 bp, Artificial Sequence
  Synthetic construct
gccatctaacttgatgttag

SEQ ID NO: 3049 - DNA, 20 bp, Artificial Sequence
  Synthetic construct
ccatctaacttgatgttagt

SEQ ID NO: 3050 - DNA, 20 bp, Artificial Sequence
  Synthetic construct
catctaacttgatgttagta

SEQ ID NO: 3051 - DNA, 20 bp, Artificial Sequence
  Synthetic construct
atctaacttgatgttagtac

SEQ ID NO: 3052 - DNA, 20 bp, Artificial Sequence
  Synthetic construct
tctaacttgatgttagtacc

SEQ ID NO: 3053 - DNA, 20 bp, Artificial Sequence
  Synthetic construct
ctaacttgatgttagtaccg

SEQ ID NO: 3054 - DNA, 20 bp, Artificial Sequence
  Synthetic construct
taacttgatgttagtaccga

SEQ ID NO: 3055 - DNA, 20 bp, Artificial Sequence
  Synthetic construct
aacttgatgttagtaccgac

SEQ ID NO: 3056 - DNA, 20 bp, Artificial Sequence
  Synthetic construct
acttgatgttagtaccgacc

SEQ ID NO: 3057 - DNA, 20 bp, Artificial Sequence
  Synthetic construct
cttgatgttagtaccgacct

SEQ ID NO: 3058 - DNA, 20 bp, Artificial Sequence
  Synthetic construct
ttgatgttagtaccgacctg

SEQ ID NO: 3059 - DNA, 20 bp, Artificial Sequence
  Synthetic construct
tgatgttagtaccgacctga

SEQ ID NO: 3060 - DNA, 20 bp, Artificial Sequence
  Synthetic construct
gatgttagtaccgacctgac

SEQ ID NO: 3061 - DNA, 20 bp, Artificial Sequence
  Synthetic construct
atgttagtaccgacctgacg

SEQ ID NO: 3062 - DNA, 20 bp, Artificial Sequence
  Synthetic construct
tgttagtaccgacctgacgt

SEQ ID NO: 3063 - DNA, 20 bp, Artificial Sequence
  Synthetic construct
gttagtaccgacctgacgta

SEQ ID NO: 3064 - DNA, 20 bp, Artificial Sequence
  Synthetic construct
ttagtaccgacctgacgtac

SEQ ID NO: 3065 - DNA, 20 bp, Artificial Sequence
  Synthetic construct
tagtaccgacctgacgtacg

SEQ ID NO: 3066 - DNA, 20 bp, Artificial Sequence
  Synthetic construct
agtaccgacctgacgtacgg

SEQ ID NO: 3067 - DNA, 20 bp, Artificial Sequence
  Synthetic construct
gtaccgacctgacgtacggc

SEQ ID NO: 3068 - DNA, 20 bp, Artificial Sequence
  Synthetic construct
taccgacctgacgtacggct

SEQ ID NO: 3069 - DNA, 20 bp, Artificial Sequence
  Synthetic construct
accgacctgacgtacggctc

SEQ ID NO: 3070 - DNA, 20 bp, Artificial Sequence
  Synthetic construct
ccgacctgacgtacggctct

SEQ ID NO: 3071 - DNA, 20 bp, Artificial Sequence
  Synthetic construct
cgacctgacgtacggctctc

SEQ ID NO: 3072 - DNA, 20 bp, Artificial Sequence
  Synthetic construct
gacctgacgtacggctctca

SEQ ID NO: 3073 - DNA, 20 bp, Artificial Sequence
  Synthetic construct
acctgacgtacggctctcat

SEQ ID NO: 3074 - DNA, 20 bp, Artificial Sequence
  Synthetic construct
cctgacgtacggctctcata

SEQ ID NO: 3075 - DNA, 20 bp, Artificial Sequence
  Synthetic construct
ctgacgtacggctctcatag

SEQ ID NO: 3076 - DNA, 20 bp, Artificial Sequence
  Synthetic construct
tgacgtacggctctcatagg

SEQ ID NO: 3077 - DNA, 20 bp, Artificial Sequence
  Synthetic construct
gacgtacggctctcatagga

SEQ ID NO: 3078 - DNA, 20 bp, Artificial Sequence
  Synthetic construct
acgtacggctctcataggaa

SEQ ID NO: 3079 - DNA, 20 bp, Artificial Sequence
  Synthetic construct
cgtacggctctcataggaag

SEQ ID NO: 3080 - DNA, 20 bp, Artificial Sequence
  Synthetic construct
gtacggctctcataggaaga

SEQ ID NO: 3081 - DNA, 20 bp, Artificial Sequence
  Synthetic construct
tacggctctcataggaagaa

SEQ ID NO: 3082 - DNA, 20 bp, Artificial Sequence
  Synthetic construct
acggctctcataggaagaaa

SEQ ID NO: 3083 - DNA, 20 bp, Artificial Sequence
  Synthetic construct
cggctctcataggaagaaac

SEQ ID NO: 3084 - DNA, 20 bp, Artificial Sequence
  Synthetic construct
ggctctcataggaagaaact

SEQ ID NO: 3085 - DNA, 20 bp, Artificial Sequence
  Synthetic construct
gctctcataggaagaaactc

SEQ ID NO: 3086 - DNA, 20 bp, Artificial Sequence
  Synthetic construct
ctctcataggaagaaactct

SEQ ID NO: 3087 - DNA, 20 bp, Artificial Sequence
  Synthetic construct
tctcataggaagaaactctt

SEQ ID NO: 3088 - DNA, 20 bp, Artificial Sequence
  Synthetic construct
ctcataggaagaaactcttg

SEQ ID NO: 3089 - DNA, 20 bp, Artificial Sequence
  Synthetic construct
tcataggaagaaactcttga

SEQ ID NO: 3090 - DNA, 20 bp, Artificial Sequence
  Synthetic construct
cataggaagaaactcttgaa

SEQ ID NO: 3091 - DNA, 20 bp, Artificial Sequence
  Synthetic construct
ataggaagaaactcttgaag

SEQ ID NO: 3092 - DNA, 20 bp, Artificial Sequence
  Synthetic construct
taggaagaaactcttgaagg

SEQ ID NO: 3093 - DNA, 20 bp, Artificial Sequence
  Synthetic construct
aggaagaaactcttgaaggt

SEQ ID NO: 3094 - DNA, 20 bp, Artificial Sequence
  Synthetic construct
ggaagaaactcttgaaggtg

SEQ ID NO: 3095 - DNA, 20 bp, Artificial Sequence
  Synthetic construct
gaagaaactcttgaaggtga

SEQ ID NO: 3096 - DNA, 20 bp, Artificial Sequence
  Synthetic construct
aagaaactcttgaaggtgaa

SEQ ID NO: 3097 - DNA, 20 bp, Artificial Sequence
  Synthetic construct
agaaactcttgaaggtgaac

SEQ ID NO: 3098 - DNA, 20 bp, Artificial Sequence
  Synthetic construct
gaaactcttgaaggtgaacc

SEQ ID NO: 3099 - DNA, 20 bp, Artificial Sequence
  Synthetic construct
aaactcttgaaggtgaacct

SEQ ID NO: 3100 - DNA, 20 bp, Artificial Sequence
  Synthetic construct
aactcttgaaggtgaacctt

SEQ ID NO: 3101 - DNA, 20 bp, Artificial Sequence
  Synthetic construct
actcttgaaggtgaaccttc

SEQ ID NO: 3102 - DNA, 20 bp, Artificial Sequence
  Synthetic construct
ctcttgaaggtgaaccttcg

SEQ ID NO: 3103 - DNA, 20 bp, Artificial Sequence
  Synthetic construct
tcttgaaggtgaaccttcgt

SEQ ID NO: 3104 - DNA, 20 bp, Artificial Sequence
  Synthetic construct
cttgaaggtgaaccttcgta

SEQ ID NO: 3105 - DNA, 20 bp, Artificial Sequence
  Synthetic construct
ttgaaggtgaaccttcgtaa

SEQ ID NO: 3106 - DNA, 20 bp, Artificial Sequence
  Synthetic construct
tgaaggtgaaccttcgtaag

SEQ ID NO: 3107 - DNA, 20 bp, Artificial Sequence
  Synthetic construct
gaaggtgaaccttcgtaagc

SEQ ID NO: 3108 - DNA, 20 bp, Artificial Sequence
  Synthetic construct
aaggtgaaccttcgtaagca

SEQ ID NO: 3109 - DNA, 20 bp, Artificial Sequence
  Synthetic construct
aggtgaaccttcgtaagcat

SEQ ID NO: 3110 - DNA, 20 bp, Artificial Sequence
  Synthetic construct
ggtgaaccttcgtaagcatc

SEQ ID NO: 3111 - DNA, 20 bp, Artificial Sequence
  Synthetic construct
gtgaaccttcgtaagcatct

SEQ ID NO: 3112 - DNA, 20 bp, Artificial Sequence
  Synthetic construct
tgaaccttcgtaagcatctc

SEQ ID NO: 3113 - DNA, 20 bp, Artificial Sequence
  Synthetic construct
gaaccttcgtaagcatctca

SEQ ID NO: 3114 - DNA, 20 bp, Artificial Sequence
  Synthetic construct
aaccttcgtaagcatctcat

SEQ ID NO: 3115 - DNA, 20 bp, Artificial Sequence
  Synthetic construct
accttcgtaagcatctcata

SEQ ID NO: 3116 - DNA, 20 bp, Artificial Sequence
  Synthetic construct
ccttcgtaagcatctcatat

SEQ ID NO: 3117 - DNA, 20 bp, Artificial Sequence
  Synthetic construct
cttcgtaagcatctcatatg

SEQ ID NO: 3118 - DNA, 20 bp, Artificial Sequence
  Synthetic construct
ttcgtaagcatctcatatgc

SEQ ID NO: 3119 - DNA, 20 bp, Artificial Sequence
  Synthetic construct
tcgtaagcatctcatatgca

SEQ ID NO: 3120 - DNA, 20 bp, Artificial Sequence
  Synthetic construct
cgtaagcatctcatatgcac

SEQ ID NO: 3121 - DNA, 20 bp, Artificial Sequence
  Synthetic construct
gtaagcatctcatatgcacc

SEQ ID NO: 3122 - DNA, 20 bp, Artificial Sequence
  Synthetic construct
taagcatctcatatgcaccc

SEQ ID NO: 3123 - DNA, 20 bp, Artificial Sequence
  Synthetic construct
aagcatctcatatgcaccct

SEQ ID NO: 3124 - DNA, 20 bp, Artificial Sequence
  Synthetic construct
agcatctcatatgcaccctg

SEQ ID NO: 3125 - DNA, 20 bp, Artificial Sequence
  Synthetic construct
gcatctcatatgcaccctgg

SEQ ID NO: 3126 - DNA, 20 bp, Artificial Sequence
  Synthetic construct
catctcatatgcaccctgga

SEQ ID NO: 3127 - DNA, 20 bp, Artificial Sequence
  Synthetic construct
atctcatatgcaccctggat

SEQ ID NO: 3128 - DNA, 20 bp, Artificial Sequence
  Synthetic construct
tctcatatgcaccctggata

SEQ ID NO: 3129 - DNA, 20 bp, Artificial Sequence
  Synthetic construct
ctcatatgcaccctggatat

SEQ ID NO: 3130 - DNA, 20 bp, Artificial Sequence
  Synthetic construct
tcatatgcaccctggatatc

SEQ ID NO: 3131 - DNA, 20 bp, Artificial Sequence
  Synthetic construct
catatgcaccctggatatca

SEQ ID NO: 3132 - DNA, 20 bp, Artificial Sequence
  Synthetic construct
atatgcaccctggatatcac

SEQ ID NO: 3133 - DNA, 20 bp, Artificial Sequence
  Synthetic construct
tatgcaccctggatatcact

SEQ ID NO: 3134 - DNA, 20 bp, Artificial Sequence
  Synthetic construct
atgcaccctggatatcactc

SEQ ID NO: 3135 - DNA, 20 bp, Artificial Sequence
  Synthetic construct
tgcaccctggatatcactca

SEQ ID NO: 3136 - DNA, 20 bp, Artificial Sequence
  Synthetic construct
gcaccctggatatcactcat

SEQ ID NO: 3137 - DNA, 20 bp, Artificial Sequence
  Synthetic construct
caccctggatatcactcatt

SEQ ID NO: 3138 - DNA, 20 bp, Artificial Sequence
  Synthetic construct
accctggatatcactcatta

SEQ ID NO: 3139 - DNA, 20 bp, Artificial Sequence
  Synthetic construct
ccctggatatcactcattag

SEQ ID NO: 3140 - DNA, 20 bp, Artificial Sequence
  Synthetic construct
cctggatatcactcattagt

SEQ ID NO: 3141 - DNA, 20 bp, Artificial Sequence
  Synthetic construct
ctggatatcactcattagtg

SEQ ID NO: 3142 - DNA, 20 bp, Artificial Sequence
  Synthetic construct
tggatatcactcattagtgg

SEQ ID NO: 3143 - DNA, 20 bp, Artificial Sequence
  Synthetic construct
ggatatcactcattagtggt

SEQ ID NO: 3144 - DNA, 20 bp, Artificial Sequence
  Synthetic construct
gatatcactcattagtggta

SEQ ID NO: 3145 - DNA, 20 bp, Artificial Sequence
  Synthetic construct
atatcactcattagtggtaa

SEQ ID NO: 3146 - DNA, 20 bp, Artificial Sequence
  Synthetic construct
tatcactcattagtggtaac

SEQ ID NO: 3147 - DNA, 20 bp, Artificial Sequence
  Synthetic construct
atcactcattagtggtaacc

SEQ ID NO: 3148 - DNA, 20 bp, Artificial Sequence
  Synthetic construct
tcactcattagtggtaacca

SEQ ID NO: 3149 - DNA, 20 bp, Artificial Sequence
  Synthetic construct
cactcattagtggtaaccaa

SEQ ID NO: 3150 - DNA, 20 bp, Artificial Sequence
  Synthetic construct
actcattagtggtaaccaac

SEQ ID NO: 3151 - DNA, 20 bp, Artificial Sequence
  Synthetic construct
ctcattagtggtaaccaacc

SEQ ID NO: 3152 - DNA, 20 bp, Artificial Sequence
  Synthetic construct
tcattagtggtaaccaaccg

SEQ ID NO: 3153 - DNA, 20 bp, Artificial Sequence
  Synthetic construct
cattagtggtaaccaaccga

SEQ ID NO: 3154 - DNA, 20 bp, Artificial Sequence
  Synthetic construct
attagtggtaaccaaccgaa

SEQ ID NO: 3155 - DNA, 20 bp, Artificial Sequence
  Synthetic construct
ttagtggtaaccaaccgaac

SEQ ID NO: 3156 - DNA, 20 bp, Artificial Sequence
  Synthetic construct
tagtggtaaccaaccgaact

SEQ ID NO: 3157 - DNA, 20 bp, Artificial Sequence
  Synthetic construct
agtggtaaccaaccgaactg

SEQ ID NO: 3158 - DNA, 20 bp, Artificial Sequence
  Synthetic construct
gtggtaaccaaccgaactgc

SEQ ID NO: 3159 - DNA, 20 bp, Artificial Sequence
  Synthetic construct
tggtaaccaaccgaactgca

SEQ ID NO: 3160 - DNA, 20 bp, Artificial Sequence
  Synthetic construct
ggtaaccaaccgaactgcaa

SEQ ID NO: 3161 - DNA, 20 bp, Artificial Sequence
  Synthetic construct
gtaaccaaccgaactgcaac

SEQ ID NO: 3162 - DNA, 20 bp, Artificial Sequence
  Synthetic construct
taaccaaccgaactgcaact

SEQ ID NO: 3163 - DNA, 20 bp, Artificial Sequence
  Synthetic construct
aaccaaccgaactgcaactc

SEQ ID NO: 3164 - DNA, 20 bp, Artificial Sequence
  Synthetic construct
accaaccgaactgcaactcc

SEQ ID NO: 3165 - DNA, 20 bp, Artificial Sequence
  Synthetic construct
ccaaccgaactgcaactcca

SEQ ID NO: 3166 - DNA, 20 bp, Artificial Sequence
  Synthetic construct
caaccgaactgcaactccaa

SEQ ID NO: 3167 - DNA, 20 bp, Artificial Sequence
  Synthetic construct
aaccgaactgcaactccaac

SEQ ID NO: 3168 - DNA, 20 bp, Artificial Sequence
  Synthetic construct
accgaactgcaactccaacc

SEQ ID NO: 3169 - DNA, 20 bp, Artificial Sequence
  Synthetic construct
ccgaactgcaactccaacca

SEQ ID NO: 3170 - DNA, 20 bp, Artificial Sequence
  Synthetic construct
cgaactgcaactccaaccac

SEQ ID NO: 3171 - DNA, 20 bp, Artificial Sequence
  Synthetic construct
gaactgcaactccaaccacc

SEQ ID NO: 3172 - DNA, 20 bp, Artificial Sequence
  Synthetic construct
aactgcaactccaaccacct

SEQ ID NO: 3173 - DNA, 20 bp, Artificial Sequence
  Synthetic construct
actgcaactccaaccacctg

SEQ ID NO: 3174 - DNA, 20 bp, Artificial Sequence
  Synthetic construct
ctgcaactccaaccacctgc

SEQ ID NO: 3175 - DNA, 20 bp, Artificial Sequence
  Synthetic construct
tgcaactccaaccacctgcc

SEQ ID NO: 3176 - DNA, 20 bp, Artificial Sequence
  Synthetic construct
gcaactccaaccacctgccg

SEQ ID NO: 3177 - DNA, 20 bp, Artificial Sequence
  Synthetic construct
caactccaaccacctgccgg

SEQ ID NO: 3178 - DNA, 20 bp, Artificial Sequence
  Synthetic construct
aactccaaccacctgccggc

SEQ ID NO: 3179 - DNA, 20 bp, Artificial Sequence
  Synthetic construct
actccaaccacctgccggcc

SEQ ID NO: 3180 - DNA, 20 bp, Artificial Sequence
  Synthetic construct
ctccaaccacctgccggcca

SEQ ID NO: 3181 - DNA, 20 bp, Artificial Sequence
  Synthetic construct
tccaaccacctgccggccac

SEQ ID NO: 3182 - DNA, 20 bp, Artificial Sequence
  Synthetic construct
ccaaccacctgccggccacg

SEQ ID NO: 3183 - DNA, 20 bp, Artificial Sequence
  Synthetic construct
caaccacctgccggccacgt

SEQ ID NO: 3184 - DNA, 20 bp, Artificial Sequence
  Synthetic construct
aaccacctgccggccacgtg

SEQ ID NO: 3185 - DNA, 20 bp, Artificial Sequence
  Synthetic construct
accacctgccggccacgtgt

SEQ ID NO: 3186 - DNA, 20 bp, Artificial Sequence
  Synthetic construct
ccacctgccggccacgtgtt

SEQ ID NO: 3187 - DNA, 20 bp, Artificial Sequence
  Synthetic construct
cacctgccggccacgtgttt

SEQ ID NO: 3188 - DNA, 20 bp, Artificial Sequence
  Synthetic construct
acctgccggccacgtgtttt

SEQ ID NO: 3189 - DNA, 20 bp, Artificial Sequence
  Synthetic construct
cctgccggccacgtgttttg

SEQ ID NO: 3190 - DNA, 20 bp, Artificial Sequence
  Synthetic construct
ctgccggccacgtgttttga

SEQ ID NO: 3191 - DNA, 20 bp, Artificial Sequence
  Synthetic construct
tgccggccacgtgttttgat

SEQ ID NO: 3192 - DNA, 20 bp, Artificial Sequence
  Synthetic construct
gccggccacgtgttttgatc

SEQ ID NO: 3193 - DNA, 20 bp, Artificial Sequence
  Synthetic construct
ccggccacgtgttttgatcg

SEQ ID NO: 3194 - DNA, 20 bp, Artificial Sequence
  Synthetic construct
cggccacgtgttttgatcga

SEQ ID NO: 3195 - DNA, 20 bp, Artificial Sequence
  Synthetic construct
ggccacgtgttttgatcgaa

SEQ ID NO: 3196 - DNA, 20 bp, Artificial Sequence
  Synthetic construct
gccacgtgttttgatcgaaa

SEQ ID NO: 3197 - DNA, 20 bp, Artificial Sequence
  Synthetic construct
ccacgtgttttgatcgaaac

SEQ ID NO: 3198 - DNA, 20 bp, Artificial Sequence
  Synthetic construct
cacgtgttttgatcgaaact

SEQ ID NO: 3199 - DNA, 20 bp, Artificial Sequence
  Synthetic construct
acgtgttttgatcgaaactt

SEQ ID NO: 3200 - DNA, 20 bp, Artificial Sequence
  Synthetic construct
cgtgttttgatcgaaacttt

SEQ ID NO: 3201 - DNA, 20 bp, Artificial Sequence
  Synthetic construct
gtgttttgatcgaaactttc

SEQ ID NO: 3202 - DNA, 20 bp, Artificial Sequence
  Synthetic construct
tgttttgatcgaaactttcg

SEQ ID NO: 3203 - DNA, 20 bp, Artificial Sequence
  Synthetic construct
gttttgatcgaaactttcga

SEQ ID NO: 3204 - DNA, 20 bp, Artificial Sequence
  Synthetic construct
ttttgatcgaaactttcgat

SEQ ID NO: 3205 - DNA, 20 bp, Artificial Sequence
  Synthetic construct
tttgatcgaaactttcgatc

SEQ ID NO: 3206 - DNA, 20 bp, Artificial Sequence
  Synthetic construct
ttgatcgaaactttcgatct

SEQ ID NO: 3207 - DNA, 20 bp, Artificial Sequence
  Synthetic construct
tgatcgaaactttcgatctt

SEQ ID NO: 3208 - DNA, 20 bp, Artificial Sequence
  Synthetic construct
gatcgaaactttcgatcttc

SEQ ID NO: 3209 - DNA, 20 bp, Artificial Sequence
  Synthetic construct
atcgaaactttcgatcttcg

SEQ ID NO: 3210 - DNA, 20 bp, Artificial Sequence
  Synthetic construct
tcgaaactttcgatcttcgt

SEQ ID NO: 3211 - DNA, 20 bp, Artificial Sequence
  Synthetic construct
cgaaactttcgatcttcgtt

SEQ ID NO: 3212 - DNA, 20 bp, Artificial Sequence
  Synthetic construct
gaaactttcgatcttcgttt

SEQ ID NO: 3213 - DNA, 20 bp, Artificial Sequence
  Synthetic construct
aaactttcgatcttcgttta

SEQ ID NO: 3214 - DNA, 20 bp, Artificial Sequence
  Synthetic construct
aactttcgatcttcgtttag

SEQ ID NO: 3215 - DNA, 20 bp, Artificial Sequence
  Synthetic construct
actttcgatcttcgtttagg

SEQ ID NO: 3216 - DNA, 20 bp, Artificial Sequence
  Synthetic construct
ctttcgatcttcgtttaggg

SEQ ID NO: 3217 - DNA, 20 bp, Artificial Sequence
  Synthetic construct
tttcgatcttcgtttagggc

SEQ ID NO: 3218 - DNA, 20 bp, Artificial Sequence
  Synthetic construct
ttcgatcttcgtttagggca

SEQ ID NO: 3219 - DNA, 20 bp, Artificial Sequence
  Synthetic construct
tcgatcttcgtttagggcaa

SEQ ID NO: 3220 - DNA, 20 bp, Artificial Sequence
  Synthetic construct
cgatcttcgtttagggcaag

SEQ ID NO: 3221 - DNA, 20 bp, Artificial Sequence
  Synthetic construct
gatcttcgtttagggcaagg

SEQ ID NO: 3222 - DNA, 20 bp, Artificial Sequence
  Synthetic construct
atcttcgtttagggcaaggt

SEQ ID NO: 3223 - DNA, 20 bp, Artificial Sequence
  Synthetic construct
tcttcgtttagggcaaggta

SEQ ID NO: 3224 - DNA, 20 bp, Artificial Sequence
  Synthetic construct
cttcgtttagggcaaggtag

SEQ ID NO: 3225 - DNA, 20 bp, Artificial Sequence
  Synthetic construct
ttcgtttagggcaaggtagc

SEQ ID NO: 3226 - DNA, 20 bp, Artificial Sequence
  Synthetic construct
tcgtttagggcaaggtagcg

SEQ ID NO: 3227 - DNA, 20 bp, Artificial Sequence
  Synthetic construct
cgtttagggcaaggtagcgg

SEQ ID NO: 3228 - DNA, 20 bp, Artificial Sequence
  Synthetic construct
gtttagggcaaggtagcgga

SEQ ID NO: 3229 - DNA, 20 bp, Artificial Sequence
  Synthetic construct
tttagggcaaggtagcggag

SEQ ID NO: 3230 - DNA, 20 bp, Artificial Sequence
  Synthetic construct
ttagggcaaggtagcggagc

SEQ ID NO: 3231 - DNA, 20 bp, Artificial Sequence
  Synthetic construct
tagggcaaggtagcggagcg

SEQ ID NO: 3232 - DNA, 20 bp, Artificial Sequence
  Synthetic construct
agggcaaggtagcggagcgc

SEQ ID NO: 3233 - DNA, 20 bp, Artificial Sequence
  Synthetic construct
gggcaaggtagcggagcgcc

SEQ ID NO: 3234 - DNA, 20 bp, Artificial Sequence
  Synthetic construct
ggcaaggtagcggagcgcct

SEQ ID NO: 3235 - DNA, 20 bp, Artificial Sequence
  Synthetic construct
gcaaggtagcggagcgcctg

SEQ ID NO: 3236 - DNA, 20 bp, Artificial Sequence
  Synthetic construct
caaggtagcggagcgcctgg

SEQ ID NO: 3237 - DNA, 20 bp, Artificial Sequence
  Synthetic construct
aaggtagcggagcgcctggc

SEQ ID NO: 3238 - DNA, 20 bp, Artificial Sequence
  Synthetic construct
aggtagcggagcgcctggcg

SEQ ID NO: 3239 - DNA, 20 bp, Artificial Sequence
  Synthetic construct
ggtagcggagcgcctggcgc

SEQ ID NO: 3240 - DNA, 20 bp, Artificial Sequence
  Synthetic construct
gtagcggagcgcctggcgcc

SEQ ID NO: 3241 - DNA, 20 bp, Artificial Sequence
  Synthetic construct
tagcggagcgcctggcgcca

SEQ ID NO: 3242 - DNA, 20 bp, Artificial Sequence
  Synthetic construct
agcggagcgcctggcgccaa

SEQ ID NO: 3243 - DNA, 20 bp, Artificial Sequence
  Synthetic construct
gcggagcgcctggcgccaat

SEQ ID NO: 3244 - DNA, 20 bp, Artificial Sequence
  Synthetic construct
cggagcgcctggcgccaatt

SEQ ID NO: 3245 - DNA, 20 bp, Artificial Sequence
  Synthetic construct
ggagcgcctggcgccaatta

SEQ ID NO: 3246 - DNA, 20 bp, Artificial Sequence
  Synthetic construct
gagcgcctggcgccaattac

SEQ ID NO: 3247 - DNA, 20 bp, Artificial Sequence
  Synthetic construct
agcgcctggcgccaattacc

SEQ ID NO: 3248 - DNA, 20 bp, Artificial Sequence
  Synthetic construct
gcgcctggcgccaattaccg

SEQ ID NO: 3249 - DNA, 20 bp, Artificial Sequence
  Synthetic construct
cgcctggcgccaattaccgc

SEQ ID NO: 3250 - DNA, 20 bp, Artificial Sequence
  Synthetic construct
gcctggcgccaattaccgcg

SEQ ID NO: 3251 - DNA, 20 bp, Artificial Sequence
  Synthetic construct
cctggcgccaattaccgcga

SEQ ID NO: 3252 - DNA, 20 bp, Artificial Sequence
  Synthetic construct
ctggcgccaattaccgcgac

SEQ ID NO: 3253 - DNA, 20 bp, Artificial Sequence
  Synthetic construct
tggcgccaattaccgcgacg

SEQ ID NO: 3254 - DNA, 20 bp, Artificial Sequence
  Synthetic construct
ggcgccaattaccgcgacga

SEQ ID NO: 3255 - DNA, 20 bp, Artificial Sequence
  Synthetic construct
gcgccaattaccgcgacgag

SEQ ID NO: 3256 - DNA, 20 bp, Artificial Sequence
  Synthetic construct
cgccaattaccgcgacgagc

SEQ ID NO: 3257 - DNA, 20 bp, Artificial Sequence
  Synthetic construct
gccaattaccgcgacgagcg

SEQ ID NO: 3258 - DNA, 20 bp, Artificial Sequence
  Synthetic construct
ccaattaccgcgacgagcgg

SEQ ID NO: 3259 - DNA, 20 bp, Artificial Sequence
  Synthetic construct
caattaccgcgacgagcggc

SEQ ID NO: 3260 - DNA, 20 bp, Artificial Sequence
  Synthetic construct
aattaccgcgacgagcggca

SEQ ID NO: 3261 - DNA, 20 bp, Artificial Sequence
  Synthetic construct
attaccgcgacgagcggcag

SEQ ID NO: 3262 - DNA, 20 bp, Artificial Sequence
  Synthetic construct
ttaccgcgacgagcggcagt

SEQ ID NO: 3263 - DNA, 20 bp, Artificial Sequence
  Synthetic construct
taccgcgacgagcggcagtg

SEQ ID NO: 3264 - DNA, 20 bp, Artificial Sequence
  Synthetic construct
accgcgacgagcggcagtgt

SEQ ID NO: 3265 - DNA, 20 bp, Artificial Sequence
  Synthetic construct
ccgcgacgagcggcagtgta

SEQ ID NO: 3266 - DNA, 20 bp, Artificial Sequence
  Synthetic construct
cgcgacgagcggcagtgtac

SEQ ID NO: 3267 - DNA, 20 bp, Artificial Sequence
  Synthetic construct
gcgacgagcggcagtgtacg

SEQ ID NO: 3268 - DNA, 20 bp, Artificial Sequence
  Synthetic construct
cgacgagcggcagtgtacgc

SEQ ID NO: 3269 - DNA, 20 bp, Artificial Sequence
  Synthetic construct
gacgagcggcagtgtacgcc

SEQ ID NO: 3270 - DNA, 20 bp, Artificial Sequence
  Synthetic construct
acgagcggcagtgtacgcct

SEQ ID NO: 3271 - DNA, 20 bp, Artificial Sequence
  Synthetic construct
cgagcggcagtgtacgcctt

SEQ ID NO: 3272 - DNA, 20 bp, Artificial Sequence
  Synthetic construct
gagcggcagtgtacgccttc

SEQ ID NO: 3273 - DNA, 20 bp, Artificial Sequence
  Synthetic construct
agcggcagtgtacgccttca

SEQ ID NO: 3274 - DNA, 20 bp, Artificial Sequence
  Synthetic construct
gcggcagtgtacgccttcac

SEQ ID NO: 3275 - DNA, 20 bp, Artificial Sequence
  Synthetic construct
cggcagtgtacgccttcacg

SEQ ID NO: 3276 - DNA, 20 bp, Artificial Sequence
  Synthetic construct
ggcagtgtacgccttcacga

SEQ ID NO: 3277 - DNA, 20 bp, Artificial Sequence
  Synthetic construct
gcagtgtacgccttcacgag

SEQ ID NO: 3278 - DNA, 20 bp, Artificial Sequence
  Synthetic construct
cagtgtacgccttcacgagc

SEQ ID NO: 3279 - DNA, 20 bp, Artificial Sequence
  Synthetic construct
agtgtacgccttcacgagcg

SEQ ID NO: 3280 - DNA, 20 bp, Artificial Sequence
  Synthetic construct
gtgtacgccttcacgagcgc

SEQ ID NO: 3281 - DNA, 20 bp, Artificial Sequence
  Synthetic construct
tgtacgccttcacgagcgca

SEQ ID NO: 3282 - DNA, 20 bp, Artificial Sequence
  Synthetic construct
gtacgccttcacgagcgcaa

SEQ ID NO: 3283 - DNA, 20 bp, Artificial Sequence
  Synthetic construct
tacgccttcacgagcgcaat

SEQ ID NO: 3284 - DNA, 20 bp, Artificial Sequence
  Synthetic construct
acgccttcacgagcgcaatg

SEQ ID NO: 3285 - DNA, 20 bp, Artificial Sequence
  Synthetic construct
cgccttcacgagcgcaatgg

SEQ ID NO: 3286 - DNA, 20 bp, Artificial Sequence
  Synthetic construct
gccttcacgagcgcaatggt

SEQ ID NO: 3287 - DNA, 20 bp, Artificial Sequence
  Synthetic construct
ccttcacgagcgcaatggtt

SEQ ID NO: 3288 - DNA, 20 bp, Artificial Sequence
  Synthetic construct
cttcacgagcgcaatggttt

SEQ ID NO: 3289 - DNA, 20 bp, Artificial Sequence
  Synthetic construct
ttcacgagcgcaatggtttg

SEQ ID NO: 3290 - DNA, 20 bp, Artificial Sequence
  Synthetic construct
tcacgagcgcaatggtttgc

SEQ ID NO: 3291 - DNA, 20 bp, Artificial Sequence
  Synthetic construct
cacgagcgcaatggtttgcg

SEQ ID NO: 3292 - DNA, 20 bp, Artificial Sequence
  Synthetic construct
acgagcgcaatggtttgcgt

SEQ ID NO: 3293 - DNA, 20 bp, Artificial Sequence
  Synthetic construct
cgagcgcaatggtttgcgtc

SEQ ID NO: 3294 - DNA, 20 bp, Artificial Sequence
  Synthetic construct
gagcgcaatggtttgcgtcg

SEQ ID NO: 3295 - DNA, 20 bp, Artificial Sequence
  Synthetic construct
agcgcaatggtttgcgtcgc

SEQ ID NO: 3296 - DNA, 20 bp, Artificial Sequence
  Synthetic construct
gcgcaatggtttgcgtcgcg

SEQ ID NO: 3297 - DNA, 20 bp, Artificial Sequence
  Synthetic construct
cgcaatggtttgcgtcgcga

SEQ ID NO: 3298 - DNA, 20 bp, Artificial Sequence
  Synthetic construct
gcaatggtttgcgtcgcgag

SEQ ID NO: 3299 - DNA, 20 bp, Artificial Sequence
  Synthetic construct
caatggtttgcgtcgcgagt

SEQ ID NO: 3300 - DNA, 20 bp, Artificial Sequence
  Synthetic construct
aatggtttgcgtcgcgagtt

SEQ ID NO: 3301 - DNA, 20 bp, Artificial Sequence
  Synthetic construct
atggtttgcgtcgcgagttg

SEQ ID NO: 3302 - DNA, 20 bp, Artificial Sequence
  Synthetic construct
tggtttgcgtcgcgagttgt

SEQ ID NO: 3303 - DNA, 20 bp, Artificial Sequence
  Synthetic construct
ggtttgcgtcgcgagttgtg

SEQ ID NO: 3304 - DNA, 20 bp, Artificial Sequence
  Synthetic construct
gtttgcgtcgcgagttgtga

SEQ ID NO: 3305 - DNA, 20 bp, Artificial Sequence
  Synthetic construct
tttgcgtcgcgagttgtgag

SEQ ID NO: 3306 - DNA, 20 bp, Artificial Sequence
  Synthetic construct
ttgcgtcgcgagttgtgagg

SEQ ID NO: 3307 - DNA, 20 bp, Artificial Sequence
  Synthetic construct
tgcgtcgcgagttgtgaggc

SEQ ID NO: 3308 - DNA, 20 bp, Artificial Sequence
  Synthetic construct
gcgtcgcgagttgtgaggct

SEQ ID NO: 3309 - DNA, 20 bp, Artificial Sequence
  Synthetic construct
cgtcgcgagttgtgaggctg

SEQ ID NO: 3310 - DNA, 20 bp, Artificial Sequence
  Synthetic construct
gtcgcgagttgtgaggctgt

SEQ ID NO: 3311 - DNA, 20 bp, Artificial Sequence
  Synthetic construct
tcgcgagttgtgaggctgtc

SEQ ID NO: 3312 - DNA, 20 bp, Artificial Sequence
  Synthetic construct
cgcgagttgtgaggctgtcg

SEQ ID NO: 3313 - DNA, 20 bp, Artificial Sequence
  Synthetic construct
gcgagttgtgaggctgtcga

SEQ ID NO: 3314 - DNA, 20 bp, Artificial Sequence
  Synthetic construct
cgagttgtgaggctgtcgac

SEQ ID NO: 3315 - DNA, 20 bp, Artificial Sequence
  Synthetic construct
gagttgtgaggctgtcgacc

SEQ ID NO: 3316 - DNA, 20 bp, Artificial Sequence
  Synthetic construct
agttgtgaggctgtcgacct

SEQ ID NO: 3317 - DNA, 20 bp, Artificial Sequence
  Synthetic construct
gttgtgaggctgtcgacctg

SEQ ID NO: 3318 - DNA, 20 bp, Artificial Sequence
  Synthetic construct
ttgtgaggctgtcgacctgg

SEQ ID NO: 3319 - DNA, 20 bp, Artificial Sequence
  Synthetic construct
tgtgaggctgtcgacctggc

SEQ ID NO: 3320 - DNA, 20 bp, Artificial Sequence
  Synthetic construct
gtgaggctgtcgacctggcc

SEQ ID NO: 3321 - DNA, 20 bp, Artificial Sequence
  Synthetic construct
tgaggctgtcgacctggcct

SEQ ID NO: 3322 - DNA, 20 bp, Artificial Sequence
  Synthetic construct
gaggctgtcgacctggcctc

SEQ ID NO: 3323 - DNA, 20 bp, Artificial Sequence
  Synthetic construct
aggctgtcgacctggcctct

SEQ ID NO: 3324 - DNA, 20 bp, Artificial Sequence
  Synthetic construct
ggctgtcgacctggcctctg

SEQ ID NO: 3325 - DNA, 20 bp, Artificial Sequence
  Synthetic construct
gctgtcgacctggcctctgc

SEQ ID NO: 3326 - DNA, 20 bp, Artificial Sequence
  Synthetic construct
ctgtcgacctggcctctgct

SEQ ID NO: 3327 - DNA, 20 bp, Artificial Sequence
  Synthetic construct
tgtcgacctggcctctgcta

SEQ ID NO: 3328 - DNA, 20 bp, Artificial Sequence
  Synthetic construct
gtcgacctggcctctgctaa

SEQ ID NO: 3329 - DNA, 20 bp, Artificial Sequence
  Synthetic construct
tcgacctggcctctgctaaa

SEQ ID NO: 3330 - DNA, 20 bp, Artificial Sequence
  Synthetic construct
cgacctggcctctgctaaag

SEQ ID NO: 3331 - DNA, 20 bp, Artificial Sequence
  Synthetic construct
gacctggcctctgctaaagc

SEQ ID NO: 3332 - DNA, 20 bp, Artificial Sequence
  Synthetic construct
acctggcctctgctaaagca

SEQ ID NO: 3333 - DNA, 20 bp, Artificial Sequence
  Synthetic construct
cctggcctctgctaaagcaa

SEQ ID NO: 3334 - DNA, 20 bp, Artificial Sequence
  Synthetic construct
ctggcctctgctaaagcaac

SEQ ID NO: 3335 - DNA, 20 bp, Artificial Sequence
  Synthetic construct
tggcctctgctaaagcaaca

SEQ ID NO: 3336 - DNA, 20 bp, Artificial Sequence
  Synthetic construct
ggcctctgctaaagcaacac

SEQ ID NO: 3337 - DNA, 20 bp, Artificial Sequence
  Synthetic construct
gcctctgctaaagcaacacc

SEQ ID NO: 3338 - DNA, 20 bp, Artificial Sequence
  Synthetic construct
cctctgctaaagcaacacca

SEQ ID NO: 3339 - DNA, 20 bp, Artificial Sequence
  Synthetic construct
ctctgctaaagcaacaccaa

SEQ ID NO: 3340 - DNA, 20 bp, Artificial Sequence
  Synthetic construct
tctgctaaagcaacaccaag

SEQ ID NO: 3341 - DNA, 20 bp, Artificial Sequence
  Synthetic construct
ctgctaaagcaacaccaagg

SEQ ID NO: 3342 - DNA, 20 bp, Artificial Sequence
  Synthetic construct
tgctaaagcaacaccaaggt

SEQ ID NO: 3343 - DNA, 20 bp, Artificial Sequence
  Synthetic construct
gctaaagcaacaccaaggtt

SEQ ID NO: 3344 - DNA, 20 bp, Artificial Sequence
  Synthetic construct
ctaaagcaacaccaaggtta

SEQ ID NO: 3345 - DNA, 20 bp, Artificial Sequence
  Synthetic construct
taaagcaacaccaaggttaa

SEQ ID NO: 3346 - DNA, 20 bp, Artificial Sequence
  Synthetic construct
aaagcaacaccaaggttaaa

SEQ ID NO: 3347 - DNA, 20 bp, Artificial Sequence
  Synthetic construct
aagcaacaccaaggttaaaa

SEQ ID NO: 3348 - DNA, 20 bp, Artificial Sequence
  Synthetic construct
agcaacaccaaggttaaaat

SEQ ID NO: 3349 - DNA, 20 bp, Artificial Sequence
  Synthetic construct
gcaacaccaaggttaaaatt

SEQ ID NO: 3350 - DNA, 20 bp, Artificial Sequence
  Synthetic construct
caacaccaaggttaaaatta

SEQ ID NO: 3351 - DNA, 20 bp, Artificial Sequence
  Synthetic construct
aacaccaaggttaaaattac

SEQ ID NO: 3352 - DNA, 20 bp, Artificial Sequence
  Synthetic construct
acaccaaggttaaaattacc

SEQ ID NO: 3353 - DNA, 20 bp, Artificial Sequence
  Synthetic construct
caccaaggttaaaattaccc

SEQ ID NO: 3354 - DNA, 20 bp, Artificial Sequence
  Synthetic construct
accaaggttaaaattaccct

SEQ ID NO: 3355 - DNA, 20 bp, Artificial Sequence
  Synthetic construct
ccaaggttaaaattaccctg

SEQ ID NO: 3356 - DNA, 20 bp, Artificial Sequence
  Synthetic construct
caaggttaaaattaccctgg

SEQ ID NO: 3357 - DNA, 20 bp, Artificial Sequence
  Synthetic construct
aaggttaaaattaccctggg

SEQ ID NO: 3358 - DNA, 20 bp, Artificial Sequence
  Synthetic construct
aggttaaaattaccctgggt

SEQ ID NO: 3359 - DNA, 20 bp, Artificial Sequence
  Synthetic construct
ggttaaaattaccctgggtg

SEQ ID NO: 3360 - DNA, 20 bp, Artificial Sequence
  Synthetic construct
gttaaaattaccctgggtga

SEQ ID NO: 3361 - DNA, 20 bp, Artificial Sequence
  Synthetic construct
ttaaaattaccctgggtgac

SEQ ID NO: 3362 - DNA, 20 bp, Artificial Sequence
  Synthetic construct
taaaattaccctgggtgacc

SEQ ID NO: 3363 - DNA, 20 bp, Artificial Sequence
  Synthetic construct
aaaattaccctgggtgacct

SEQ ID NO: 3364 - DNA, 20 bp, Artificial Sequence
  Synthetic construct
aaattaccctgggtgacctt

SEQ ID NO: 3365 - DNA, 20 bp, Artificial Sequence
  Synthetic construct
aattaccctgggtgaccttt

SEQ ID NO: 3366 - DNA, 20 bp, Artificial Sequence
  Synthetic construct
attaccctgggtgacctttt

SEQ ID NO: 3367 - DNA, 20 bp, Artificial Sequence
  Synthetic construct
ttaccctgggtgaccttttg

SEQ ID NO: 3368 - DNA, 20 bp, Artificial Sequence
  Synthetic construct
taccctgggtgaccttttgc

SEQ ID NO: 3369 - DNA, 20 bp, Artificial Sequence
  Synthetic construct
accctgggtgaccttttgca

SEQ ID NO: 3370 - DNA, 20 bp, Artificial Sequence
  Synthetic construct
ccctgggtgaccttttgcag

SEQ ID NO: 3371 - DNA, 20 bp, Artificial Sequence
  Synthetic construct
cctgggtgaccttttgcagg

SEQ ID NO: 3372 - DNA, 20 bp, Artificial Sequence
  Synthetic construct
ctgggtgaccttttgcagga

SEQ ID NO: 3373 - DNA, 20 bp, Artificial Sequence
  Synthetic construct
tgggtgaccttttgcaggac

SEQ ID NO: 3374 - DNA, 20 bp, Artificial Sequence
  Synthetic construct
gggtgaccttttgcaggact

SEQ ID NO: 3375 - DNA, 20 bp, Artificial Sequence
  Synthetic construct
ggtgaccttttgcaggactt

SEQ ID NO: 3376 - DNA, 20 bp, Artificial Sequence
  Synthetic construct
gtgaccttttgcaggacttc

SEQ ID NO: 3377 - DNA, 20 bp, Artificial Sequence
  Synthetic construct
tgaccttttgcaggacttcg

SEQ ID NO: 3378 - DNA, 20 bp, Artificial Sequence
  Synthetic construct
gaccttttgcaggacttcgg

SEQ ID NO: 3379 - DNA, 20 bp, Artificial Sequence
  Synthetic construct
accttttgcaggacttcggt

SEQ ID NO: 3380 - DNA, 20 bp, Artificial Sequence
  Synthetic construct
ccttttgcaggacttcggtc

SEQ ID NO: 3381 - DNA, 20 bp, Artificial Sequence
  Synthetic construct
cttttgcaggacttcggtcg

SEQ ID NO: 3382 - DNA, 20 bp, Artificial Sequence
  Synthetic construct
ttttgcaggacttcggtcga

SEQ ID NO: 3383 - DNA, 20 bp, Artificial Sequence
  Synthetic construct
tttgcaggacttcggtcgac

SEQ ID NO: 3384 - DNA, 20 bp, Artificial Sequence
  Synthetic construct
ttgcaggacttcggtcgacg

SEQ ID NO: 3385 - DNA, 20 bp, Artificial Sequence
  Synthetic construct
tgcaggacttcggtcgacgc

SEQ ID NO: 3386 - DNA, 20 bp, Artificial Sequence
  Synthetic construct
gcaggacttcggtcgacgcc

SEQ ID NO: 3387 - DNA, 20 bp, Artificial Sequence
  Synthetic construct
caggacttcggtcgacgccc

SEQ ID NO: 3388 - DNA, 20 bp, Artificial Sequence
  Synthetic construct
aggacttcggtcgacgcccg

SEQ ID NO: 3389 - DNA, 20 bp, Artificial Sequence
  Synthetic construct
ggacttcggtcgacgcccgg

SEQ ID NO: 3390 - DNA, 20 bp, Artificial Sequence
  Synthetic construct
gacttcggtcgacgcccggt

SEQ ID NO: 3391 - DNA, 20 bp, Artificial Sequence
  Synthetic construct
acttcggtcgacgcccggtt

SEQ ID NO: 3392 - DNA, 20 bp, Artificial Sequence
  Synthetic construct
cttcggtcgacgcccggttc

SEQ ID NO: 3393 - DNA, 20 bp, Artificial Sequence
  Synthetic construct
ttcggtcgacgcccggttcg

SEQ ID NO: 3394 - DNA, 20 bp, Artificial Sequence
  Synthetic construct
tcggtcgacgcccggttcgc

SEQ ID NO: 3395 - DNA, 20 bp, Artificial Sequence
  Synthetic construct
cggtcgacgcccggttcgca

SEQ ID NO: 3396 - DNA, 20 bp, Artificial Sequence
  Synthetic construct
ggtcgacgcccggttcgcaa

SEQ ID NO: 3397 - DNA, 20 bp, Artificial Sequence
  Synthetic construct
gtcgacgcccggttcgcaac

SEQ ID NO: 3398 - DNA, 20 bp, Artificial Sequence
  Synthetic construct
tcgacgcccggttcgcaacg

SEQ ID NO: 3399 - DNA, 20 bp, Artificial Sequence
  Synthetic construct
cgacgcccggttcgcaacgt

SEQ ID NO: 3400 - DNA, 20 bp, Artificial Sequence
  Synthetic construct
gacgcccggttcgcaacgtt

SEQ ID NO: 3401 - DNA, 20 bp, Artificial Sequence
  Synthetic construct
acgcccggttcgcaacgttc

SEQ ID NO: 3402 - DNA, 20 bp, Artificial Sequence
  Synthetic construct
cgcccggttcgcaacgttct

SEQ ID NO: 3403 - DNA, 20 bp, Artificial Sequence
  Synthetic construct
gcccggttcgcaacgttctg

SEQ ID NO: 3404 - DNA, 20 bp, Artificial Sequence
  Synthetic construct
cccggttcgcaacgttctgc

SEQ ID NO: 3405 - DNA, 20 bp, Artificial Sequence
  Synthetic construct
ccggttcgcaacgttctgcg

SEQ ID NO: 3406 - DNA, 20 bp, Artificial Sequence
  Synthetic construct
cggttcgcaacgttctgcgg

SEQ ID NO: 3407 - DNA, 20 bp, Artificial Sequence
  Synthetic construct
ggttcgcaacgttctgcggc

SEQ ID NO: 3408 - DNA, 20 bp, Artificial Sequence
  Synthetic construct
gttcgcaacgttctgcggca

SEQ ID NO: 3409 - DNA, 20 bp, Artificial Sequence
  Synthetic construct
ttcgcaacgttctgcggcac

SEQ ID NO: 3410 - DNA, 20 bp, Artificial Sequence
  Synthetic construct
tcgcaacgttctgcggcact

SEQ ID NO: 3411 - DNA, 20 bp, Artificial Sequence
  Synthetic construct
cgcaacgttctgcggcactt

SEQ ID NO: 3412 - DNA, 20 bp, Artificial Sequence
  Synthetic construct
gcaacgttctgcggcacttc

SEQ ID NO: 3413 - DNA, 20 bp, Artificial Sequence
  Synthetic construct
caacgttctgcggcacttcg

SEQ ID NO: 3414 - DNA, 20 bp, Artificial Sequence
  Synthetic construct
aacgttctgcggcacttcga

SEQ ID NO: 3415 - DNA, 20 bp, Artificial Sequence
  Synthetic construct
acgttctgcggcacttcgat

SEQ ID NO: 3416 - DNA, 20 bp, Artificial Sequence
  Synthetic construct
cgttctgcggcacttcgatg

SEQ ID NO: 3417 - DNA, 20 bp, Artificial Sequence
  Synthetic construct
gttctgcggcacttcgatgt

SEQ ID NO: 3418 - DNA, 20 bp, Artificial Sequence
  Synthetic construct
ttctgcggcacttcgatgta

SEQ ID NO: 3419 - DNA, 20 bp, Artificial Sequence
  Synthetic construct
tctgcggcacttcgatgtaa

SEQ ID NO: 3420 - DNA, 20 bp, Artificial Sequence
  Synthetic construct
ctgcggcacttcgatgtaag

SEQ ID NO: 3421 - DNA, 20 bp, Artificial Sequence
  Synthetic construct
tgcggcacttcgatgtaagt

SEQ ID NO: 3422 - DNA, 20 bp, Artificial Sequence
  Synthetic construct
gcggcacttcgatgtaagtc

SEQ ID NO: 3423 - DNA, 20 bp, Artificial Sequence
  Synthetic construct
cggcacttcgatgtaagtca

SEQ ID NO: 3424 - DNA, 20 bp, Artificial Sequence
  Synthetic construct
ggcacttcgatgtaagtcaa

SEQ ID NO: 3425 - DNA, 20 bp, Artificial Sequence
  Synthetic construct
gcacttcgatgtaagtcaag

SEQ ID NO: 3426 - DNA, 20 bp, Artificial Sequence
  Synthetic construct
cacttcgatgtaagtcaagt

SEQ ID NO: 3427 - DNA, 20 bp, Artificial Sequence
  Synthetic construct
acttcgatgtaagtcaagtt

SEQ ID NO: 3428 - DNA, 20 bp, Artificial Sequence
  Synthetic construct
cttcgatgtaagtcaagttt

SEQ ID NO: 3429 - DNA, 20 bp, Artificial Sequence
  Synthetic construct
ttcgatgtaagtcaagtttt

SEQ ID NO: 3430 - DNA, 20 bp, Artificial Sequence
  Synthetic construct
tcgatgtaagtcaagttttg

SEQ ID NO: 3431 - DNA, 20 bp, Artificial Sequence
  Synthetic construct
cgatgtaagtcaagttttgg

SEQ ID NO: 3432 - DNA, 20 bp, Artificial Sequence
  Synthetic construct
gatgtaagtcaagttttggc

SEQ ID NO: 3433 - DNA, 20 bp, Artificial Sequence
  Synthetic construct
atgtaagtcaagttttggct

SEQ ID NO: 3434 - DNA, 20 bp, Artificial Sequence
  Synthetic construct
tgtaagtcaagttttggctt

SEQ ID NO: 3435 - DNA, 20 bp, Artificial Sequence
  Synthetic construct
gtaagtcaagttttggctta

SEQ ID NO: 3436 - DNA, 20 bp, Artificial Sequence
  Synthetic construct
taagtcaagttttggcttac

SEQ ID NO: 3437 - DNA, 20 bp, Artificial Sequence
  Synthetic construct
aagtcaagttttggcttaca

SEQ ID NO: 3438 - DNA, 20 bp, Artificial Sequence
  Synthetic construct
agtcaagttttggcttacag

SEQ ID NO: 3439 - DNA, 20 bp, Artificial Sequence
  Synthetic construct
gtcaagttttggcttacagg

SEQ ID NO: 3440 - DNA, 20 bp, Artificial Sequence
  Synthetic construct
tcaagttttggcttacaggg

SEQ ID NO: 3441 - DNA, 20 bp, Artificial Sequence
  Synthetic construct
caagttttggcttacaggga

SEQ ID NO: 3442 - DNA, 20 bp, Artificial Sequence
  Synthetic construct
aagttttggcttacagggaa

SEQ ID NO: 3443 - DNA, 20 bp, Artificial Sequence
  Synthetic construct
agttttggcttacagggaag

SEQ ID NO: 3444 - DNA, 20 bp, Artificial Sequence
  Synthetic construct
gttttggcttacagggaaga

SEQ ID NO: 3445 - DNA, 20 bp, Artificial Sequence
  Synthetic construct
ttttggcttacagggaagag

SEQ ID NO: 3446 - DNA, 20 bp, Artificial Sequence
  Synthetic construct
tttggcttacagggaagagg

SEQ ID NO: 3447 - DNA, 20 bp, Artificial Sequence
  Synthetic construct
ttggcttacagggaagaggc

SEQ ID NO: 3448 - DNA, 20 bp, Artificial Sequence
  Synthetic construct
tggcttacagggaagaggct

SEQ ID NO: 3449 - DNA, 20 bp, Artificial Sequence
  Synthetic construct
ggcttacagggaagaggctg

SEQ ID NO: 3450 - DNA, 20 bp, Artificial Sequence
  Synthetic construct
gcttacagggaagaggctgt

SEQ ID NO: 3451 - DNA, 20 bp, Artificial Sequence
  Synthetic construct
cttacagggaagaggctgta

SEQ ID NO: 3452 - DNA, 20 bp, Artificial Sequence
  Synthetic construct
ttacagggaagaggctgtag

SEQ ID NO: 3453 - DNA, 20 bp, Artificial Sequence
  Synthetic construct
tacagggaagaggctgtagc

SEQ ID NO: 3454 - DNA, 20 bp, Artificial Sequence
  Synthetic construct
acagggaagaggctgtagca

SEQ ID NO: 3455 - DNA, 20 bp, Artificial Sequence
  Synthetic construct
cagggaagaggctgtagcag

SEQ ID NO: 3456 - DNA, 20 bp, Artificial Sequence
  Synthetic construct
agggaagaggctgtagcagg

SEQ ID NO: 3457 - DNA, 20 bp, Artificial Sequence
  Synthetic construct
gggaagaggctgtagcagga

SEQ ID NO: 3458 - DNA, 20 bp, Artificial Sequence
  Synthetic construct
ggaagaggctgtagcaggag

SEQ ID NO: 3459 - DNA, 20 bp, Artificial Sequence
  Synthetic construct
gaagaggctgtagcaggagc

SEQ ID NO: 3460 - DNA, 20 bp, Artificial Sequence
  Synthetic construct
aagaggctgtagcaggagcg

SEQ ID NO: 3461 - DNA, 20 bp, Artificial Sequence
  Synthetic construct
agaggctgtagcaggagcgt

SEQ ID NO: 3462 - DNA, 20 bp, Artificial Sequence
  Synthetic construct
gaggctgtagcaggagcgtg

SEQ ID NO: 3463 - DNA, 20 bp, Artificial Sequence
  Synthetic construct
aggctgtagcaggagcgtgc

SEQ ID NO: 3464 - DNA, 20 bp, Artificial Sequence
  Synthetic construct
ggctgtagcaggagcgtgcg

SEQ ID NO: 3465 - DNA, 20 bp, Artificial Sequence
  Synthetic construct
gctgtagcaggagcgtgcgt

SEQ ID NO: 3466 - DNA, 20 bp, Artificial Sequence
  Synthetic construct
ctgtagcaggagcgtgcgtc

SEQ ID NO: 3467 - DNA, 20 bp, Artificial Sequence
  Synthetic construct
tgtagcaggagcgtgcgtcg

SEQ ID NO: 3468 - DNA, 20 bp, Artificial Sequence
  Synthetic construct
gtagcaggagcgtgcgtcga

SEQ ID NO: 3469 - DNA, 20 bp, Artificial Sequence
  Synthetic construct
tagcaggagcgtgcgtcgag

SEQ ID NO: 3470 - DNA, 20 bp, Artificial Sequence
  Synthetic construct
agcaggagcgtgcgtcgagg

SEQ ID NO: 3471 - DNA, 20 bp, Artificial Sequence
  Synthetic construct
gcaggagcgtgcgtcgaggg

SEQ ID NO: 3472 - DNA, 20 bp, Artificial Sequence
  Synthetic construct
caggagcgtgcgtcgaggga

SEQ ID NO: 3473 - DNA, 20 bp, Artificial Sequence
  Synthetic construct
aggagcgtgcgtcgagggag

SEQ ID NO: 3474 - DNA, 20 bp, Artificial Sequence
  Synthetic construct
ggagcgtgcgtcgagggaga

SEQ ID NO: 3475 - DNA, 20 bp, Artificial Sequence
  Synthetic construct
gagcgtgcgtcgagggagaa

SEQ ID NO: 3476 - DNA, 20 bp, Artificial Sequence
  Synthetic construct
agcgtgcgtcgagggagaag

SEQ ID NO: 3477 - DNA, 20 bp, Artificial Sequence
  Synthetic construct
gcgtgcgtcgagggagaagc

SEQ ID NO: 3478 - DNA, 20 bp, Artificial Sequence
  Synthetic construct
cgtgcgtcgagggagaagcc

SEQ ID NO: 3479 - DNA, 20 bp, Artificial Sequence
  Synthetic construct
gtgcgtcgagggagaagccg

SEQ ID NO: 3480 - DNA, 20 bp, Artificial Sequence
  Synthetic construct
tgcgtcgagggagaagccga

SEQ ID NO: 3481 - DNA, 20 bp, Artificial Sequence
  Synthetic construct
gcgtcgagggagaagccgaa

SEQ ID NO: 3482 - DNA, 20 bp, Artificial Sequence
  Synthetic construct
cgtcgagggagaagccgaaa

SEQ ID NO: 3483 - DNA, 20 bp, Artificial Sequence
  Synthetic construct
gtcgagggagaagccgaaac

SEQ ID NO: 3484 - DNA, 20 bp, Artificial Sequence
  Synthetic construct
tcgagggagaagccgaaacc

SEQ ID NO: 3485 - DNA, 20 bp, Artificial Sequence
  Synthetic construct
cgagggagaagccgaaaccg

SEQ ID NO: 3486 - DNA, 20 bp, Artificial Sequence
  Synthetic construct
gagggagaagccgaaaccgg

SEQ ID NO: 3487 - DNA, 20 bp, Artificial Sequence
  Synthetic construct
agggagaagccgaaaccggc

SEQ ID NO: 3488 - DNA, 20 bp, Artificial Sequence
  Synthetic construct
gggagaagccgaaaccggct

SEQ ID NO: 3489 - DNA, 20 bp, Artificial Sequence
  Synthetic construct
ggagaagccgaaaccggctt

SEQ ID NO: 3490 - DNA, 20 bp, Artificial Sequence
  Synthetic construct
gagaagccgaaaccggcttt

SEQ ID NO: 3491 - DNA, 20 bp, Artificial Sequence
  Synthetic construct
agaagccgaaaccggctttc

SEQ ID NO: 3492 - DNA, 20 bp, Artificial Sequence
  Synthetic construct
gaagccgaaaccggctttct

SEQ ID NO: 3493 - DNA, 20 bp, Artificial Sequence
  Synthetic construct
aagccgaaaccggctttctc

SEQ ID NO: 3494 - DNA, 20 bp, Artificial Sequence
  Synthetic construct
agccgaaaccggctttctcc

SEQ ID NO: 3495 - DNA, 20 bp, Artificial Sequence
  Synthetic construct
gccgaaaccggctttctcct

SEQ ID NO: 3496 - DNA, 20 bp, Artificial Sequence
  Synthetic construct
ccgaaaccggctttctcctc

SEQ ID NO: 3497 - DNA, 20 bp, Artificial Sequence
  Synthetic construct
cgaaaccggctttctcctcg

SEQ ID NO: 3498 - DNA, 20 bp, Artificial Sequence
  Synthetic construct
gaaaccggctttctcctcgt

SEQ ID NO: 3499 - DNA, 20 bp, Artificial Sequence
  Synthetic construct
aaaccggctttctcctcgta

SEQ ID NO: 3500 - DNA, 20 bp, Artificial Sequence
  Synthetic construct
aaccggctttctcctcgtac

SEQ ID NO: 3501 - DNA, 20 bp, Artificial Sequence
  Synthetic construct
accggctttctcctcgtacg

SEQ ID NO: 3502 - DNA, 20 bp, Artificial Sequence
  Synthetic construct
ccggctttctcctcgtacgg

SEQ ID NO: 3503 - DNA, 20 bp, Artificial Sequence
  Synthetic construct
cggctttctcctcgtacggg

SEQ ID NO: 3504 - DNA, 20 bp, Artificial Sequence
  Synthetic construct
ggctttctcctcgtacgggc

SEQ ID NO: 3505 - DNA, 20 bp, Artificial Sequence
  Synthetic construct
gctttctcctcgtacgggcg

SEQ ID NO: 3506 - DNA, 20 bp, Artificial Sequence
  Synthetic construct
ctttctcctcgtacgggcga

SEQ ID NO: 3507 - DNA, 20 bp, Artificial Sequence
  Synthetic construct
tttctcctcgtacgggcgac

SEQ ID NO: 3508 - DNA, 20 bp, Artificial Sequence
  Synthetic construct
ttctcctcgtacgggcgacc

SEQ ID NO: 3509 - DNA, 20 bp, Artificial Sequence
  Synthetic construct
tctcctcgtacgggcgaccc

SEQ ID NO: 3510 - DNA, 20 bp, Artificial Sequence
  Synthetic construct
ctcctcgtacgggcgacccc

SEQ ID NO: 3511 - DNA, 20 bp, Artificial Sequence
  Synthetic construct
tcctcgtacgggcgacccca

SEQ ID NO: 3512 - DNA, 20 bp, Artificial Sequence
  Synthetic construct
cctcgtacgggcgaccccac

SEQ ID NO: 3513 - DNA, 20 bp, Artificial Sequence
  Synthetic construct
ctcgtacgggcgaccccacg

SEQ ID NO: 3514 - DNA, 20 bp, Artificial Sequence
  Synthetic construct
tcgtacgggcgaccccacga

SEQ ID NO: 3515 - DNA, 20 bp, Artificial Sequence
  Synthetic construct
cgtacgggcgaccccacgat

SEQ ID NO: 3516 - DNA, 20 bp, Artificial Sequence
  Synthetic construct
gtacgggcgaccccacgatg

SEQ ID NO: 3517 - DNA, 20 bp, Artificial Sequence
  Synthetic construct
tacgggcgaccccacgatga

SEQ ID NO: 3518 - DNA, 20 bp, Artificial Sequence
  Synthetic construct
acgggcgaccccacgatgac

SEQ ID NO: 3519 - DNA, 20 bp, Artificial Sequence
  Synthetic construct
cgggcgaccccacgatgacc

SEQ ID NO: 3520 - DNA, 20 bp, Artificial Sequence
  Synthetic construct
gggcgaccccacgatgaccc

SEQ ID NO: 3521 - DNA, 20 bp, Artificial Sequence
  Synthetic construct
ggcgaccccacgatgaccca

SEQ ID NO: 3522 - DNA, 20 bp, Artificial Sequence
  Synthetic construct
gcgaccccacgatgacccac

SEQ ID NO: 3523 - DNA, 20 bp, Artificial Sequence
  Synthetic construct
cgaccccacgatgacccact

SEQ ID NO: 3524 - DNA, 20 bp, Artificial Sequence
  Synthetic construct
gaccccacgatgacccactt

SEQ ID NO: 3525 - DNA, 20 bp, Artificial Sequence
  Synthetic construct
accccacgatgacccacttc

SEQ ID NO: 3526 - DNA, 20 bp, Artificial Sequence
  Synthetic construct
ccccacgatgacccacttcg

SEQ ID NO: 3527 - DNA, 20 bp, Artificial Sequence
  Synthetic construct
cccacgatgacccacttcgc

SEQ ID NO: 3528 - DNA, 20 bp, Artificial Sequence
  Synthetic construct
ccacgatgacccacttcgct

SEQ ID NO: 3529 - DNA, 20 bp, Artificial Sequence
  Synthetic construct
cacgatgacccacttcgctt

SEQ ID NO: 3530 - DNA, 20 bp, Artificial Sequence
  Synthetic construct
acgatgacccacttcgcttg

SEQ ID NO: 3531 - DNA, 20 bp, Artificial Sequence
  Synthetic construct
cgatgacccacttcgcttgt

SEQ ID NO: 3532 - DNA, 20 bp, Artificial Sequence
  Synthetic construct
gatgacccacttcgcttgta

SEQ ID NO: 3533 - DNA, 20 bp, Artificial Sequence
  Synthetic construct
atgacccacttcgcttgtag

SEQ ID NO: 3534 - DNA, 20 bp, Artificial Sequence
  Synthetic construct
tgacccacttcgcttgtagg

SEQ ID NO: 3535 - DNA, 20 bp, Artificial Sequence
  Synthetic construct
gacccacttcgcttgtaggc

SEQ ID NO: 3536 - DNA, 20 bp, Artificial Sequence
  Synthetic construct
acccacttcgcttgtaggca

SEQ ID NO: 3537 - DNA, 20 bp, Artificial Sequence
  Synthetic construct
cccacttcgcttgtaggcac

SEQ ID NO: 3538 - DNA, 20 bp, Artificial Sequence
  Synthetic construct
ccacttcgcttgtaggcacc

SEQ ID NO: 3539 - DNA, 20 bp, Artificial Sequence
  Synthetic construct
cacttcgcttgtaggcacct

SEQ ID NO: 3540 - DNA, 20 bp, Artificial Sequence
  Synthetic construct
acttcgcttgtaggcacctt

SEQ ID NO: 3541 - DNA, 20 bp, Artificial Sequence
  Synthetic construct
cttcgcttgtaggcaccttg

SEQ ID NO: 3542 - DNA, 20 bp, Artificial Sequence
  Synthetic construct
ttcgcttgtaggcaccttga

SEQ ID NO: 3543 - DNA, 20 bp, Artificial Sequence
  Synthetic construct
tcgcttgtaggcaccttgat

SEQ ID NO: 3544 - DNA, 20 bp, Artificial Sequence
  Synthetic construct
cgcttgtaggcaccttgatc

SEQ ID NO: 3545 - DNA, 20 bp, Artificial Sequence
  Synthetic construct
gcttgtaggcaccttgatct

SEQ ID NO: 3546 - DNA, 20 bp, Artificial Sequence
  Synthetic construct
cttgtaggcaccttgatcta

SEQ ID NO: 3547 - DNA, 20 bp, Artificial Sequence
  Synthetic construct
ttgtaggcaccttgatctat

SEQ ID NO: 3548 - DNA, 20 bp, Artificial Sequence
  Synthetic construct
tgtaggcaccttgatctatc

SEQ ID NO: 3549 - DNA, 20 bp, Artificial Sequence
  Synthetic construct
gtaggcaccttgatctatcg

SEQ ID NO: 3550 - DNA, 20 bp, Artificial Sequence
  Synthetic construct
taggcaccttgatctatcga

SEQ ID NO: 3551 - DNA, 20 bp, Artificial Sequence
  Synthetic construct
aggcaccttgatctatcgat

SEQ ID NO: 3552 - DNA, 20 bp, Artificial Sequence
  Synthetic construct
ggcaccttgatctatcgatg

SEQ ID NO: 3553 - DNA, 20 bp, Artificial Sequence
  Synthetic construct
gcaccttgatctatcgatgt

SEQ ID NO: 3554 - DNA, 20 bp, Artificial Sequence
  Synthetic construct
caccttgatctatcgatgtg

SEQ ID NO: 3555 - DNA, 20 bp, Artificial Sequence
  Synthetic construct
accttgatctatcgatgtga

SEQ ID NO: 3556 - DNA, 20 bp, Artificial Sequence
  Synthetic construct
ccttgatctatcgatgtgac

SEQ ID NO: 3557 - DNA, 20 bp, Artificial Sequence
  Synthetic construct
cttgatctatcgatgtgaca

SEQ ID NO: 3558 - DNA, 20 bp, Artificial Sequence
  Synthetic construct
ttgatctatcgatgtgacac

SEQ ID NO: 3559 - DNA, 20 bp, Artificial Sequence
  Synthetic construct
tgatctatcgatgtgacact

SEQ ID NO: 3560 - DNA, 20 bp, Artificial Sequence
  Synthetic construct
gatctatcgatgtgacactt

SEQ ID NO: 3561 - DNA, 20 bp, Artificial Sequence
  Synthetic construct
atctatcgatgtgacactta

SEQ ID NO: 3562 - DNA, 20 bp, Artificial Sequence
  Synthetic construct
tctatcgatgtgacacttaa

SEQ ID NO: 3563 - DNA, 20 bp, Artificial Sequence
  Synthetic construct
ctatcgatgtgacacttaac

SEQ ID NO: 3564 - DNA, 20 bp, Artificial Sequence
  Synthetic construct
tatcgatgtgacacttaacg

SEQ ID NO: 3565 - DNA, 20 bp, Artificial Sequence
  Synthetic construct
atcgatgtgacacttaacgc

SEQ ID NO: 3566 - DNA, 20 bp, Artificial Sequence
  Synthetic construct
tcgatgtgacacttaacgcc

SEQ ID NO: 3567 - DNA, 20 bp, Artificial Sequence
  Synthetic construct
cgatgtgacacttaacgccc

SEQ ID NO: 3568 - DNA, 20 bp, Artificial Sequence
  Synthetic construct
gatgtgacacttaacgcccc

SEQ ID NO: 3569 - DNA, 20 bp, Artificial Sequence
  Synthetic construct
atgtgacacttaacgccccc

SEQ ID NO: 3570 - DNA, 20 bp, Artificial Sequence
  Synthetic construct
tgtgacacttaacgcccccc

SEQ ID NO: 3571 - DNA, 20 bp, Artificial Sequence
  Synthetic construct
gtgacacttaacgccccccg

SEQ ID NO: 3572 - DNA, 20 bp, Artificial Sequence
  Synthetic construct
tgacacttaacgccccccgt

SEQ ID NO: 3573 - DNA, 20 bp, Artificial Sequence
  Synthetic construct
gacacttaacgccccccgtg

SEQ ID NO: 3574 - DNA, 20 bp, Artificial Sequence
  Synthetic construct
acacttaacgccccccgtga

SEQ ID NO: 3575 - DNA, 20 bp, Artificial Sequence
  Synthetic construct
cacttaacgccccccgtgaa

SEQ ID NO: 3576 - DNA, 20 bp, Artificial Sequence
  Synthetic construct
acttaacgccccccgtgaat

SEQ ID NO: 3577 - DNA, 20 bp, Artificial Sequence
  Synthetic construct
cttaacgccccccgtgaata

SEQ ID NO: 3578 - DNA, 20 bp, Artificial Sequence
  Synthetic construct
ttaacgccccccgtgaatac

SEQ ID NO: 3579 - DNA, 20 bp, Artificial Sequence
  Synthetic construct
taacgccccccgtgaatacg

SEQ ID NO: 3580 - DNA, 20 bp, Artificial Sequence
  Synthetic construct
aacgccccccgtgaatacgg

SEQ ID NO: 3581 - DNA, 20 bp, Artificial Sequence
  Synthetic construct
acgccccccgtgaatacgga

SEQ ID NO: 3582 - DNA, 20 bp, Artificial Sequence
  Synthetic construct
cgccccccgtgaatacggag

SEQ ID NO: 3583 - DNA, 20 bp, Artificial Sequence
  Synthetic construct
gccccccgtgaatacggaga

SEQ ID NO: 3584 - DNA, 20 bp, Artificial Sequence
  Synthetic construct
ccccccgtgaatacggagag

SEQ ID NO: 3585 - DNA, 20 bp, Artificial Sequence
  Synthetic construct
cccccgtgaatacggagagg

SEQ ID NO: 3586 - DNA, 20 bp, Artificial Sequence
  Synthetic construct
ccccgtgaatacggagaggg

SEQ ID NO: 3587 - DNA, 20 bp, Artificial Sequence
  Synthetic construct
cccgtgaatacggagagggg

SEQ ID NO: 3588 - DNA, 20 bp, Artificial Sequence
  Synthetic construct
ccgtgaatacggagaggggt

SEQ ID NO: 3589 - DNA, 20 bp, Artificial Sequence
  Synthetic construct
cgtgaatacggagaggggta

SEQ ID NO: 3590 - DNA, 20 bp, Artificial Sequence
  Synthetic construct
gtgaatacggagaggggtag

SEQ ID NO: 3591 - DNA, 20 bp, Artificial Sequence
  Synthetic construct
tgaatacggagaggggtagt

SEQ ID NO: 3592 - DNA, 20 bp, Artificial Sequence
  Synthetic construct
gaatacggagaggggtagtg

SEQ ID NO: 3593 - DNA, 20 bp, Artificial Sequence
  Synthetic construct
aatacggagaggggtagtgc

SEQ ID NO: 3594 - DNA, 20 bp, Artificial Sequence
  Synthetic construct
atacggagaggggtagtgcc

SEQ ID NO: 3595 - DNA, 20 bp, Artificial Sequence
  Synthetic construct
tacggagaggggtagtgcca

SEQ ID NO: 3596 - DNA, 20 bp, Artificial Sequence
  Synthetic construct
acggagaggggtagtgccac

SEQ ID NO: 3597 - DNA, 20 bp, Artificial Sequence
  Synthetic construct
cggagaggggtagtgccact

SEQ ID NO: 3598 - DNA, 20 bp, Artificial Sequence
  Synthetic construct
ggagaggggtagtgccactg

SEQ ID NO: 3599 - DNA, 20 bp, Artificial Sequence
  Synthetic construct
gagaggggtagtgccactgt

SEQ ID NO: 3600 - DNA, 20 bp, Artificial Sequence
  Synthetic construct
agaggggtagtgccactgtt

SEQ ID NO: 3601 - DNA, 20 bp, Artificial Sequence
  Synthetic construct
gaggggtagtgccactgttt

SEQ ID NO: 3602 - DNA, 20 bp, Artificial Sequence
  Synthetic construct
aggggtagtgccactgtttc

SEQ ID NO: 3603 - DNA, 20 bp, Artificial Sequence
  Synthetic construct
ggggtagtgccactgtttcg

SEQ ID NO: 3604 - DNA, 20 bp, Artificial Sequence
  Synthetic construct
gggtagtgccactgtttcgt

SEQ ID NO: 3605 - DNA, 20 bp, Artificial Sequence
  Synthetic construct
ggtagtgccactgtttcgtt

SEQ ID NO: 3606 - DNA, 20 bp, Artificial Sequence
  Synthetic construct
gtagtgccactgtttcgttt

SEQ ID NO: 3607 - DNA, 20 bp, Artificial Sequence
  Synthetic construct
tagtgccactgtttcgtttt

SEQ ID NO: 3608 - DNA, 20 bp, Artificial Sequence
  Synthetic construct
agtgccactgtttcgttttg

SEQ ID NO: 3609 - DNA, 20 bp, Artificial Sequence
  Synthetic construct
gtgccactgtttcgttttgg

SEQ ID NO: 3610 - DNA, 20 bp, Artificial Sequence
  Synthetic construct
tgccactgtttcgttttggc

SEQ ID NO: 3611 - DNA, 20 bp, Artificial Sequence
  Synthetic construct
gccactgtttcgttttggcc

SEQ ID NO: 3612 - DNA, 20 bp, Artificial Sequence
  Synthetic construct
ccactgtttcgttttggccc

SEQ ID NO: 3613 - DNA, 20 bp, Artificial Sequence
  Synthetic construct
cactgtttcgttttggcccc

SEQ ID NO: 3614 - DNA, 20 bp, Artificial Sequence
  Synthetic construct
actgtttcgttttggcccca

SEQ ID NO: 3615 - DNA, 20 bp, Artificial Sequence
  Synthetic construct
ctgtttcgttttggccccag

SEQ ID NO: 3616 - DNA, 20 bp, Artificial Sequence
  Synthetic construct
tgtttcgttttggccccagt

SEQ ID NO: 3617 - DNA, 20 bp, Artificial Sequence
  Synthetic construct
gtttcgttttggccccagtc

SEQ ID NO: 3618 - DNA, 20 bp, Artificial Sequence
  Synthetic construct
tttcgttttggccccagtcg

SEQ ID NO: 3619 - DNA, 20 bp, Artificial Sequence
  Synthetic construct
ttcgttttggccccagtcga

SEQ ID NO: 3620 - DNA, 20 bp, Artificial Sequence
  Synthetic construct
tcgttttggccccagtcgag

SEQ ID NO: 3621 - DNA, 20 bp, Artificial Sequence
  Synthetic construct
cgttttggccccagtcgagt

SEQ ID NO: 3622 - DNA, 20 bp, Artificial Sequence
  Synthetic construct
gttttggccccagtcgagtt

SEQ ID NO: 3623 - DNA, 20 bp, Artificial Sequence
  Synthetic construct
ttttggccccagtcgagtta

SEQ ID NO: 3624 - DNA, 20 bp, Artificial Sequence
  Synthetic construct
tttggccccagtcgagttaa

SEQ ID NO: 3625 - DNA, 20 bp, Artificial Sequence
  Synthetic construct
ttggccccagtcgagttaaa

SEQ ID NO: 3626 - DNA, 20 bp, Artificial Sequence
  Synthetic construct
tggccccagtcgagttaaaa

SEQ ID NO: 3627 - DNA, 20 bp, Artificial Sequence
  Synthetic construct
ggccccagtcgagttaaaac

SEQ ID NO: 3628 - DNA, 20 bp, Artificial Sequence
  Synthetic construct
gccccagtcgagttaaaacg

SEQ ID NO: 3629 - DNA, 20 bp, Artificial Sequence
  Synthetic construct
ccccagtcgagttaaaacga

SEQ ID NO: 3630 - DNA, 20 bp, Artificial Sequence
  Synthetic construct
cccagtcgagttaaaacgac

SEQ ID NO: 3631 - DNA, 20 bp, Artificial Sequence
  Synthetic construct
ccagtcgagttaaaacgacc

SEQ ID NO: 3632 - DNA, 20 bp, Artificial Sequence
  Synthetic construct
cagtcgagttaaaacgaccg

SEQ ID NO: 3633 - DNA, 20 bp, Artificial Sequence
  Synthetic construct
agtcgagttaaaacgaccgg

SEQ ID NO: 3634 - DNA, 20 bp, Artificial Sequence
  Synthetic construct
gtcgagttaaaacgaccggg

SEQ ID NO: 3635 - DNA, 20 bp, Artificial Sequence
  Synthetic construct
tcgagttaaaacgaccggga

SEQ ID NO: 3636 - DNA, 20 bp, Artificial Sequence
  Synthetic construct
cgagttaaaacgaccgggag

SEQ ID NO: 3637 - DNA, 20 bp, Artificial Sequence
  Synthetic construct
gagttaaaacgaccgggagt

SEQ ID NO: 3638 - DNA, 20 bp, Artificial Sequence
  Synthetic construct
agttaaaacgaccgggagtc

SEQ ID NO: 3639 - DNA, 20 bp, Artificial Sequence
  Synthetic construct
gttaaaacgaccgggagtcc

SEQ ID NO: 3640 - DNA, 20 bp, Artificial Sequence
  Synthetic construct
ttaaaacgaccgggagtcca

SEQ ID NO: 3641 - DNA, 20 bp, Artificial Sequence
  Synthetic construct
taaaacgaccgggagtccag

SEQ ID NO: 3642 - DNA, 20 bp, Artificial Sequence
  Synthetic construct
aaaacgaccgggagtccagt

SEQ ID NO: 3643 - DNA, 20 bp, Artificial Sequence
  Synthetic construct
aaacgaccgggagtccagtt

SEQ ID NO: 3644 - DNA, 20 bp, Artificial Sequence
  Synthetic construct
aacgaccgggagtccagttc

SEQ ID NO: 3645 - DNA, 20 bp, Artificial Sequence
  Synthetic construct
acgaccgggagtccagttcg

SEQ ID NO: 3646 - DNA, 20 bp, Artificial Sequence
  Synthetic construct
cgaccgggagtccagttcga

SEQ ID NO: 3647 - DNA, 20 bp, Artificial Sequence
  Synthetic construct
gaccgggagtccagttcgaa

SEQ ID NO: 3648 - DNA, 20 bp, Artificial Sequence
  Synthetic construct
accgggagtccagttcgaac

SEQ ID NO: 3649 - DNA, 20 bp, Artificial Sequence
  Synthetic construct
ccgggagtccagttcgaacg

SEQ ID NO: 3650 - DNA, 20 bp, Artificial Sequence
  Synthetic construct
cgggagtccagttcgaacga

SEQ ID NO: 3651 - DNA, 20 bp, Artificial Sequence
  Synthetic construct
gggagtccagttcgaacgat

SEQ ID NO: 3652 - DNA, 20 bp, Artificial Sequence
  Synthetic construct
ggagtccagttcgaacgata

SEQ ID NO: 3653 - DNA, 20 bp, Artificial Sequence
  Synthetic construct
gagtccagttcgaacgatat

SEQ ID NO: 3654 - DNA, 20 bp, Artificial Sequence
  Synthetic construct
agtccagttcgaacgatatt

SEQ ID NO: 3655 - DNA, 20 bp, Artificial Sequence
  Synthetic construct
gtccagttcgaacgatattt

SEQ ID NO: 3656 - DNA, 20 bp, Artificial Sequence
  Synthetic construct
tccagttcgaacgatatttt

SEQ ID NO: 3657 - DNA, 20 bp, Artificial Sequence
  Synthetic construct
ccagttcgaacgatatttta

SEQ ID NO: 3658 - DNA, 20 bp, Artificial Sequence
  Synthetic construct
cagttcgaacgatattttaa

SEQ ID NO: 3659 - DNA, 20 bp, Artificial Sequence
  Synthetic construct
agttcgaacgatattttaaa

SEQ ID NO: 3660 - DNA, 20 bp, Artificial Sequence
  Synthetic construct
gttcgaacgatattttaaag

SEQ ID NO: 3661 - DNA, 20 bp, Artificial Sequence
  Synthetic construct
ttcgaacgatattttaaaga

SEQ ID NO: 3662 - DNA, 20 bp, Artificial Sequence
  Synthetic construct
tcgaacgatattttaaagag

SEQ ID NO: 3663 - DNA, 20 bp, Artificial Sequence
  Synthetic construct
cgaacgatattttaaagaga

SEQ ID NO: 3664 - DNA, 20 bp, Artificial Sequence
  Synthetic construct
gaacgatattttaaagagaa

SEQ ID NO: 3665 - DNA, 20 bp, Artificial Sequence
  Synthetic construct
aacgatattttaaagagaat

SEQ ID NO: 3666 - DNA, 20 bp, Artificial Sequence
  Synthetic construct
acgatattttaaagagaatg

SEQ ID NO: 3667 - DNA, 20 bp, Artificial Sequence
  Synthetic construct
cgatattttaaagagaatga

SEQ ID NO: 3668 - DNA, 20 bp, Artificial Sequence
  Synthetic construct
gatattttaaagagaatgag

SEQ ID NO: 3669 - DNA, 20 bp, Artificial Sequence
  Synthetic construct
atattttaaagagaatgagt

SEQ ID NO: 3670 - DNA, 20 bp, Artificial Sequence
  Synthetic construct
tattttaaagagaatgagtt

SEQ ID NO: 3671 - DNA, 20 bp, Artificial Sequence
  Synthetic construct
attttaaagagaatgagtta

SEQ ID NO: 3672 - DNA, 20 bp, Artificial Sequence
  Synthetic construct
ttttaaagagaatgagttat

SEQ ID NO: 3673 - DNA, 20 bp, Artificial Sequence
  Synthetic construct
tttaaagagaatgagttatc

SEQ ID NO: 3674 - DNA, 20 bp, Artificial Sequence
  Synthetic construct
ttaaagagaatgagttatct

SEQ ID NO: 3675 - DNA, 20 bp, Artificial Sequence
  Synthetic construct
taaagagaatgagttatctt

SEQ ID NO: 3676 - DNA, 20 bp, Artificial Sequence
  Synthetic construct
aaagagaatgagttatcttc

SEQ ID NO: 3677 - DNA, 20 bp, Artificial Sequence
  Synthetic construct
aagagaatgagttatcttca

SEQ ID NO: 3678 - DNA, 20 bp, Artificial Sequence
  Synthetic construct
agagaatgagttatcttcag

SEQ ID NO: 3679 - DNA, 20 bp, Artificial Sequence
  Synthetic construct
gagaatgagttatcttcagt

SEQ ID NO: 3680 - DNA, 20 bp, Artificial Sequence
  Synthetic construct
agaatgagttatcttcagtc

SEQ ID NO: 3681 - DNA, 20 bp, Artificial Sequence
  Synthetic construct
gaatgagttatcttcagtct

SEQ ID NO: 3682 - DNA, 20 bp, Artificial Sequence
  Synthetic construct
aatgagttatcttcagtctc

SEQ ID NO: 3683 - DNA, 20 bp, Artificial Sequence
  Synthetic construct
atgagttatcttcagtctca

SEQ ID NO: 3684 - DNA, 20 bp, Artificial Sequence
  Synthetic construct
tgagttatcttcagtctcac

SEQ ID NO: 3685 - DNA, 20 bp, Artificial Sequence
  Synthetic construct
gagttatcttcagtctcacc

SEQ ID NO: 3686 - DNA, 20 bp, Artificial Sequence
  Synthetic construct
agttatcttcagtctcaccg

SEQ ID NO: 3687 - DNA, 20 bp, Artificial Sequence
  Synthetic construct
gttatcttcagtctcaccgt

SEQ ID NO: 3688 - DNA, 20 bp, Artificial Sequence
  Synthetic construct
ttatcttcagtctcaccgtc

SEQ ID NO: 3689 - DNA, 20 bp, Artificial Sequence
  Synthetic construct
tatcttcagtctcaccgtcc

SEQ ID NO: 3690 - DNA, 20 bp, Artificial Sequence
  Synthetic construct
atcttcagtctcaccgtccg

SEQ ID NO: 3691 - DNA, 20 bp, Artificial Sequence
  Synthetic construct
tcttcagtctcaccgtccgc

SEQ ID NO: 3692 - DNA, 20 bp, Artificial Sequence
  Synthetic construct
cttcagtctcaccgtccgcg

SEQ ID NO: 3693 - DNA, 20 bp, Artificial Sequence
  Synthetic construct
ttcagtctcaccgtccgcgt

SEQ ID NO: 3694 - DNA, 20 bp, Artificial Sequence
  Synthetic construct
tcagtctcaccgtccgcgta

SEQ ID NO: 3695 - DNA, 20 bp, Artificial Sequence
  Synthetic construct
cagtctcaccgtccgcgtaa

SEQ ID NO: 3696 - DNA, 20 bp, Artificial Sequence
  Synthetic construct
agtctcaccgtccgcgtaaa

SEQ ID NO: 3697 - DNA, 20 bp, Artificial Sequence
  Synthetic construct
gtctcaccgtccgcgtaaac

SEQ ID NO: 3698 - DNA, 20 bp, Artificial Sequence
  Synthetic construct
tctcaccgtccgcgtaaacg

SEQ ID NO: 3699 - DNA, 20 bp, Artificial Sequence
  Synthetic construct
ctcaccgtccgcgtaaacgc

SEQ ID NO: 3700 - DNA, 20 bp, Artificial Sequence
  Synthetic construct
tcaccgtccgcgtaaacgcg

SEQ ID NO: 3701 - DNA, 20 bp, Artificial Sequence
  Synthetic construct
caccgtccgcgtaaacgcga

SEQ ID NO: 3702 - DNA, 20 bp, Artificial Sequence
  Synthetic construct
accgtccgcgtaaacgcgaa

SEQ ID NO: 3703 - DNA, 20 bp, Artificial Sequence
  Synthetic construct
ccgtccgcgtaaacgcgaac

SEQ ID NO: 3704 - DNA, 20 bp, Artificial Sequence
  Synthetic construct
cgtccgcgtaaacgcgaacg

SEQ ID NO: 3705 - DNA, 20 bp, Artificial Sequence
  Synthetic construct
gtccgcgtaaacgcgaacgg

SEQ ID NO: 3706 - DNA, 20 bp, Artificial Sequence
  Synthetic construct
tccgcgtaaacgcgaacgga

SEQ ID NO: 3707 - DNA, 20 bp, Artificial Sequence
  Synthetic construct
ccgcgtaaacgcgaacggag

SEQ ID NO: 3708 - DNA, 20 bp, Artificial Sequence
  Synthetic construct
cgcgtaaacgcgaacggagg

SEQ ID NO: 3709 - DNA, 20 bp, Artificial Sequence
  Synthetic construct
gcgtaaacgcgaacggaggg

SEQ ID NO: 3710 - DNA, 20 bp, Artificial Sequence
  Synthetic construct
cgtaaacgcgaacggagggg

SEQ ID NO: 3711 - DNA, 20 bp, Artificial Sequence
  Synthetic construct
gtaaacgcgaacggagggga

SEQ ID NO: 3712 - DNA, 20 bp, Artificial Sequence
  Synthetic construct
taaacgcgaacggaggggac

SEQ ID NO: 3713 - DNA, 20 bp, Artificial Sequence
  Synthetic construct
aaacgcgaacggaggggacg

SEQ ID NO: 3714 - DNA, 20 bp, Artificial Sequence
  Synthetic construct
aacgcgaacggaggggacga

SEQ ID NO: 3715 - DNA, 20 bp, Artificial Sequence
  Synthetic construct
acgcgaacggaggggacgaa

SEQ ID NO: 3716 - DNA, 20 bp, Artificial Sequence
  Synthetic construct
cgcgaacggaggggacgaag

SEQ ID NO: 3717 - DNA, 20 bp, Artificial Sequence
  Synthetic construct
gcgaacggaggggacgaagg

SEQ ID NO: 3718 - DNA, 20 bp, Artificial Sequence
  Synthetic construct
cgaacggaggggacgaaggt

SEQ ID NO: 3719 - DNA, 20 bp, Artificial Sequence
  Synthetic construct
gaacggaggggacgaaggtc

SEQ ID NO: 3720 - DNA, 20 bp, Artificial Sequence
  Synthetic construct
aacggaggggacgaaggtct

SEQ ID NO: 3721 - DNA, 20 bp, Artificial Sequence
  Synthetic construct
acggaggggacgaaggtctc

SEQ ID NO: 3722 - DNA, 20 bp, Artificial Sequence
  Synthetic construct
cggaggggacgaaggtctcg

SEQ ID NO: 3723 - DNA, 20 bp, Artificial Sequence
  Synthetic construct
ggaggggacgaaggtctcgt

SEQ ID NO: 3724 - DNA, 20 bp, Artificial Sequence
  Synthetic construct
gaggggacgaaggtctcgtt

SEQ ID NO: 3725 - DNA, 20 bp, Artificial Sequence
  Synthetic construct
aggggacgaaggtctcgttc

SEQ ID NO: 3726 - DNA, 20 bp, Artificial Sequence
  Synthetic construct
ggggacgaaggtctcgttct

SEQ ID NO: 3727 - DNA, 20 bp, Artificial Sequence
  Synthetic construct
gggacgaaggtctcgttctc

SEQ ID NO: 3728 - DNA, 20 bp, Artificial Sequence
  Synthetic construct
ggacgaaggtctcgttctcc

SEQ ID NO: 3729 - DNA, 20 bp, Artificial Sequence
  Synthetic construct
gacgaaggtctcgttctccc

SEQ ID NO: 3730 - DNA, 20 bp, Artificial Sequence
  Synthetic construct
acgaaggtctcgttctccct

SEQ ID NO: 3731 - DNA, 20 bp, Artificial Sequence
  Synthetic construct
cgaaggtctcgttctcccta

SEQ ID NO: 3732 - DNA, 20 bp, Artificial Sequence
  Synthetic construct
gaaggtctcgttctccctat

SEQ ID NO: 3733 - DNA, 20 bp, Artificial Sequence
  Synthetic construct
aaggtctcgttctccctatc

SEQ ID NO: 3734 - DNA, 20 bp, Artificial Sequence
  Synthetic construct
aggtctcgttctccctatca

SEQ ID NO: 3735 - DNA, 20 bp, Artificial Sequence
  Synthetic construct
ggtctcgttctccctatcaa

SEQ ID NO: 3736 - DNA, 20 bp, Artificial Sequence
  Synthetic construct
gtctcgttctccctatcaag

SEQ ID NO: 3737 - DNA, 20 bp, Artificial Sequence
  Synthetic construct
tctcgttctccctatcaagg

SEQ ID NO: 3738 - DNA, 20 bp, Artificial Sequence
  Synthetic construct
ctcgttctccctatcaaggg

SEQ ID NO: 3739 - DNA, 20 bp, Artificial Sequence
  Synthetic construct
tcgttctccctatcaagggt

SEQ ID NO: 3740 - DNA, 20 bp, Artificial Sequence
  Synthetic construct
cgttctccctatcaagggta

SEQ ID NO: 3741 - DNA, 20 bp, Artificial Sequence
  Synthetic construct
gttctccctatcaagggtac

SEQ ID NO: 3742 - DNA, 20 bp, Artificial Sequence
  Synthetic construct
ttctccctatcaagggtact

SEQ ID NO: 3743 - DNA, 20 bp, Artificial Sequence
  Synthetic construct
tctccctatcaagggtacta

SEQ ID NO: 3744 - DNA, 20 bp, Artificial Sequence
  Synthetic construct
ctccctatcaagggtactaa

SEQ ID NO: 3745 - DNA, 20 bp, Artificial Sequence
  Synthetic construct
tccctatcaagggtactaaa

SEQ ID NO: 3746 - DNA, 20 bp, Artificial Sequence
  Synthetic construct
ccctatcaagggtactaaaa

SEQ ID NO: 3747 - DNA, 20 bp, Artificial Sequence
  Synthetic construct
cctatcaagggtactaaaag

SEQ ID NO: 3748 - DNA, 20 bp, Artificial Sequence
  Synthetic construct
ctatcaagggtactaaaagc

SEQ ID NO: 3749 - DNA, 20 bp, Artificial Sequence
  Synthetic construct
tatcaagggtactaaaagct

SEQ ID NO: 3750 - DNA, 20 bp, Artificial Sequence
  Synthetic construct
atcaagggtactaaaagctc

SEQ ID NO: 3751 - DNA, 20 bp, Artificial Sequence
  Synthetic construct
tcaagggtactaaaagctcg

SEQ ID NO: 3752 - DNA, 20 bp, Artificial Sequence
  Synthetic construct
caagggtactaaaagctcgc

SEQ ID NO: 3753 - DNA, 20 bp, Artificial Sequence
  Synthetic construct
aagggtactaaaagctcgca

SEQ ID NO: 3754 - DNA, 20 bp, Artificial Sequence
  Synthetic construct
agggtactaaaagctcgcac

SEQ ID NO: 3755 - DNA, 20 bp, Artificial Sequence
  Synthetic construct
gggtactaaaagctcgcaca

SEQ ID NO: 3756 - DNA, 20 bp, Artificial Sequence
  Synthetic construct
ggtactaaaagctcgcacag

SEQ ID NO: 3757 - DNA, 20 bp, Artificial Sequence
  Synthetic construct
gtactaaaagctcgcacagg

SEQ ID NO: 3758 - DNA, 20 bp, Artificial Sequence
  Synthetic construct
tactaaaagctcgcacaggt

SEQ ID NO: 3759 - DNA, 20 bp, Artificial Sequence
  Synthetic construct
actaaaagctcgcacaggtc

SEQ ID NO: 3760 - DNA, 20 bp, Artificial Sequence
  Synthetic construct
ctaaaagctcgcacaggtca

SEQ ID NO: 3761 - DNA, 20 bp, Artificial Sequence
  Synthetic construct
taaaagctcgcacaggtcaa

SEQ ID NO: 3762 - DNA, 20 bp, Artificial Sequence
  Synthetic construct
aaaagctcgcacaggtcaaa

SEQ ID NO: 3763 - DNA, 20 bp, Artificial Sequence
  Synthetic construct
aaagctcgcacaggtcaaac

SEQ ID NO: 3764 - DNA, 20 bp, Artificial Sequence
  Synthetic construct
aagctcgcacaggtcaaacc

SEQ ID NO: 3765 - DNA, 20 bp, Artificial Sequence
  Synthetic construct
agctcgcacaggtcaaacct

SEQ ID NO: 3766 - DNA, 20 bp, Artificial Sequence
  Synthetic construct
gctcgcacaggtcaaacctc

SEQ ID NO: 3767 - DNA, 20 bp, Artificial Sequence
  Synthetic construct
ctcgcacaggtcaaacctcc

SEQ ID NO: 3768 - DNA, 20 bp, Artificial Sequence
  Synthetic construct
tcgcacaggtcaaacctcct

SEQ ID NO: 3769 - DNA, 20 bp, Artificial Sequence
  Synthetic construct
cgcacaggtcaaacctccta

SEQ ID NO: 3770 - DNA, 20 bp, Artificial Sequence
  Synthetic construct
gcacaggtcaaacctcctag

SEQ ID NO: 3771 - DNA, 20 bp, Artificial Sequence
  Synthetic construct
cacaggtcaaacctcctagg

SEQ ID NO: 3772 - DNA, 20 bp, Artificial Sequence
  Synthetic construct
acaggtcaaacctcctagga

SEQ ID NO: 3773 - DNA, 20 bp, Artificial Sequence
  Synthetic construct
caggtcaaacctcctaggaa

SEQ ID NO: 3774 - DNA, 20 bp, Artificial Sequence
  Synthetic construct
aggtcaaacctcctaggaat

SEQ ID NO: 3775 - DNA, 20 bp, Artificial Sequence
  Synthetic construct
ggtcaaacctcctaggaatg

SEQ ID NO: 3776 - DNA, 20 bp, Artificial Sequence
  Synthetic construct
gtcaaacctcctaggaatgg

SEQ ID NO: 3777 - DNA, 20 bp, Artificial Sequence
  Synthetic construct
tcaaacctcctaggaatgga

SEQ ID NO: 3778 - DNA, 20 bp, Artificial Sequence
  Synthetic construct
caaacctcctaggaatggaa

SEQ ID NO: 3779 - DNA, 20 bp, Artificial Sequence
  Synthetic construct
aaacctcctaggaatggaat

SEQ ID NO: 3780 - DNA, 20 bp, Artificial Sequence
  Synthetic construct
aacctcctaggaatggaatt

SEQ ID NO: 3781 - DNA, 20 bp, Artificial Sequence
  Synthetic construct
acctcctaggaatggaattc

SEQ ID NO: 3782 - DNA, 20 bp, Artificial Sequence
  Synthetic construct
cctcctaggaatggaattcc

SEQ ID NO: 3783 - DNA, 20 bp, Artificial Sequence
  Synthetic construct
ctcctaggaatggaattccg

SEQ ID NO: 3784 - DNA, 20 bp, Artificial Sequence
  Synthetic construct
tcctaggaatggaattccgg

SEQ ID NO: 3785 - DNA, 20 bp, Artificial Sequence
  Synthetic construct
cctaggaatggaattccggc

SEQ ID NO: 3786 - DNA, 20 bp, Artificial Sequence
  Synthetic construct
ctaggaatggaattccggct

SEQ ID NO: 3787 - DNA, 20 bp, Artificial Sequence
  Synthetic construct
taggaatggaattccggcta

SEQ ID NO: 3788 - DNA, 20 bp, Artificial Sequence
  Synthetic construct
aggaatggaattccggctac

SEQ ID NO: 3789 - DNA, 20 bp, Artificial Sequence
  Synthetic construct
ggaatggaattccggctacc

SEQ ID NO: 3790 - DNA, 20 bp, Artificial Sequence
  Synthetic construct
gaatggaattccggctacct

SEQ ID NO: 3791 - DNA, 20 bp, Artificial Sequence
  Synthetic construct
aatggaattccggctaccta

SEQ ID NO: 3792 - DNA, 20 bp, Artificial Sequence
  Synthetic construct
atggaattccggctacctac

SEQ ID NO: 3793 - DNA, 20 bp, Artificial Sequence
  Synthetic construct
tggaattccggctacctaca

SEQ ID NO: 3794 - DNA, 20 bp, Artificial Sequence
  Synthetic construct
ggaattccggctacctacag

SEQ ID NO: 3795 - DNA, 20 bp, Artificial Sequence
  Synthetic construct
gaattccggctacctacagc

SEQ ID NO: 3796 - DNA, 20 bp, Artificial Sequence
  Synthetic construct
aattccggctacctacagcg

SEQ ID NO: 3797 - DNA, 20 bp, Artificial Sequence
  Synthetic construct
attccggctacctacagcga

SEQ ID NO: 3798 - DNA, 20 bp, Artificial Sequence
  Synthetic construct
ttccggctacctacagcgat

SEQ ID NO: 3799 - DNA, 20 bp, Artificial Sequence
  Synthetic construct
tccggctacctacagcgata

SEQ ID NO: 3800 - DNA, 20 bp, Artificial Sequence
  Synthetic construct
ccggctacctacagcgatag

SEQ ID NO: 3801 - DNA, 20 bp, Artificial Sequence
  Synthetic construct
cggctacctacagcgatagc

SEQ ID NO: 3802 - DNA, 20 bp, Artificial Sequence
  Synthetic construct
ggctacctacagcgatagcc

SEQ ID NO: 3803 - DNA, 20 bp, Artificial Sequence
  Synthetic construct
gctacctacagcgatagcca

SEQ ID NO: 3804 - DNA, 20 bp, Artificial Sequence
  Synthetic construct
ctacctacagcgatagccat

SEQ ID NO: 3805 - DNA, 20 bp, Artificial Sequence
  Synthetic construct
tacctacagcgatagccatg

SEQ ID NO: 3806 - DNA, 20 bp, Artificial Sequence
  Synthetic construct
acctacagcgatagccatgg

SEQ ID NO: 3807 - DNA, 20 bp, Artificial Sequence
  Synthetic construct
cctacagcgatagccatggt

SEQ ID NO: 3808 - DNA, 20 bp, Artificial Sequence
  Synthetic construct
ctacagcgatagccatggta

SEQ ID NO: 3809 - DNA, 20 bp, Artificial Sequence
  Synthetic construct
tacagcgatagccatggtag

SEQ ID NO: 3810 - DNA, 20 bp, Artificial Sequence
  Synthetic construct
acagcgatagccatggtagc

SEQ ID NO: 3811 - DNA, 20 bp, Artificial Sequence
  Synthetic construct
cagcgatagccatggtagcg

SEQ ID NO: 3812 - DNA, 20 bp, Artificial Sequence
  Synthetic construct
agcgatagccatggtagcgt

SEQ ID NO: 3813 - DNA, 20 bp, Artificial Sequence
  Synthetic construct
gcgatagccatggtagcgtc

SEQ ID NO: 3814 - DNA, 20 bp, Artificial Sequence
  Synthetic construct
cgatagccatggtagcgtct

SEQ ID NO: 3815 - DNA, 20 bp, Artificial Sequence
  Synthetic construct
gatagccatggtagcgtctc

SEQ ID NO: 3816 - DNA, 20 bp, Artificial Sequence
  Synthetic construct
atagccatggtagcgtctcg

SEQ ID NO: 3817 - DNA, 20 bp, Artificial Sequence
  Synthetic construct
tagccatggtagcgtctcgc

SEQ ID NO: 3818 - DNA, 20 bp, Artificial Sequence
  Synthetic construct
agccatggtagcgtctcgct

SEQ ID NO: 3819 - DNA, 20 bp, Artificial Sequence
  Synthetic construct
gccatggtagcgtctcgcta

SEQ ID NO: 3820 - DNA, 20 bp, Artificial Sequence
  Synthetic construct
ccatggtagcgtctcgctaa

SEQ ID NO: 3821 - DNA, 20 bp, Artificial Sequence
  Synthetic construct
catggtagcgtctcgctaaa

SEQ ID NO: 3822 - DNA, 20 bp, Artificial Sequence
  Synthetic construct
atggtagcgtctcgctaaag

SEQ ID NO: 3823 - DNA, 20 bp, Artificial Sequence
  Synthetic construct
tggtagcgtctcgctaaaga

SEQ ID NO: 3824 - DNA, 20 bp, Artificial Sequence
  Synthetic construct
ggtagcgtctcgctaaagac

SEQ ID NO: 3825 - DNA, 20 bp, Artificial Sequence
  Synthetic construct
gtagcgtctcgctaaagaca

SEQ ID NO: 3826 - DNA, 20 bp, Artificial Sequence
  Synthetic construct
tagcgtctcgctaaagacat

SEQ ID NO: 3827 - DNA, 20 bp, Artificial Sequence
  Synthetic construct
agcgtctcgctaaagacatt

SEQ ID NO: 3828 - DNA, 20 bp, Artificial Sequence
  Synthetic construct
gcgtctcgctaaagacatta

SEQ ID NO: 3829 - DNA, 20 bp, Artificial Sequence
  Synthetic construct
cgtctcgctaaagacattaa

SEQ ID NO: 3830 - DNA, 20 bp, Artificial Sequence
  Synthetic construct
gtctcgctaaagacattaaa

SEQ ID NO: 3831 - DNA, 20 bp, Artificial Sequence
  Synthetic construct
tctcgctaaagacattaaaa

SEQ ID NO: 3832 - DNA, 20 bp, Artificial Sequence
  Synthetic construct
ctcgctaaagacattaaaaa

SEQ ID NO: 3833 - DNA, 20 bp, Artificial Sequence
  Synthetic construct
tcgctaaagacattaaaaat

SEQ ID NO: 3834 - DNA, 20 bp, Artificial Sequence
  Synthetic construct
cgctaaagacattaaaaatg

SEQ ID NO: 3835 - DNA, 20 bp, Artificial Sequence
  Synthetic construct
gctaaagacattaaaaatgg

SEQ ID NO: 3836 - DNA, 20 bp, Artificial Sequence
  Synthetic construct
ctaaagacattaaaaatggc

SEQ ID NO: 3837 - DNA, 20 bp, Artificial Sequence
  Synthetic construct
taaagacattaaaaatggca

SEQ ID NO: 3838 - DNA, 20 bp, Artificial Sequence
  Synthetic construct
aaagacattaaaaatggcat

SEQ ID NO: 3839 - DNA, 20 bp, Artificial Sequence
  Synthetic construct
aagacattaaaaatggcatt

SEQ ID NO: 3840 - DNA, 20 bp, Artificial Sequence
  Synthetic construct
agacattaaaaatggcatta

SEQ ID NO: 3841 - DNA, 20 bp, Artificial Sequence
  Synthetic construct
gacattaaaaatggcattag

SEQ ID NO: 3842 - DNA, 20 bp, Artificial Sequence
  Synthetic construct
acattaaaaatggcattagc

SEQ ID NO: 3843 - DNA, 20 bp, Artificial Sequence
  Synthetic construct
cattaaaaatggcattagct

SEQ ID NO: 3844 - DNA, 20 bp, Artificial Sequence
  Synthetic construct
attaaaaatggcattagctc

SEQ ID NO: 3845 - DNA, 20 bp, Artificial Sequence
  Synthetic construct
ttaaaaatggcattagctcg

SEQ ID NO: 3846 - DNA, 20 bp, Artificial Sequence
  Synthetic construct
taaaaatggcattagctcga

SEQ ID NO: 3847 - DNA, 20 bp, Artificial Sequence
  Synthetic construct
aaaaatggcattagctcgac

SEQ ID NO: 3848 - DNA, 20 bp, Artificial Sequence
  Synthetic construct
aaaatggcattagctcgaca

SEQ ID NO: 3849 - DNA, 20 bp, Artificial Sequence
  Synthetic construct
aaatggcattagctcgacag

SEQ ID NO: 3850 - DNA, 20 bp, Artificial Sequence
  Synthetic construct
aatggcattagctcgacagg

SEQ ID NO: 3851 - DNA, 20 bp, Artificial Sequence
  Synthetic construct
atggcattagctcgacagga

SEQ ID NO: 3852 - DNA, 20 bp, Artificial Sequence
  Synthetic construct
tggcattagctcgacaggaa

SEQ ID NO: 3853 - DNA, 20 bp, Artificial Sequence
  Synthetic construct
ggcattagctcgacaggaag

SEQ ID NO: 3854 - DNA, 20 bp, Artificial Sequence
  Synthetic construct
gcattagctcgacaggaagt

SEQ ID NO: 3855 - DNA, 20 bp, Artificial Sequence
  Synthetic construct
cattagctcgacaggaagtt

SEQ ID NO: 3856 - DNA, 20 bp, Artificial Sequence
  Synthetic construct
attagctcgacaggaagttg

SEQ ID NO: 3857 - DNA, 20 bp, Artificial Sequence
  Synthetic construct
ttagctcgacaggaagttga

SEQ ID NO: 3858 - DNA, 20 bp, Artificial Sequence
  Synthetic construct
tagctcgacaggaagttgag

SEQ ID NO: 3859 - DNA, 20 bp, Artificial Sequence
  Synthetic construct
agctcgacaggaagttgagc

SEQ ID NO: 3860 - DNA, 20 bp, Artificial Sequence
  Synthetic construct
gctcgacaggaagttgagca

SEQ ID NO: 3861 - DNA, 20 bp, Artificial Sequence
  Synthetic construct
ctcgacaggaagttgagcag

SEQ ID NO: 3862 - DNA, 20 bp, Artificial Sequence
  Synthetic construct
tcgacaggaagttgagcagg

SEQ ID NO: 3863 - DNA, 20 bp, Artificial Sequence
  Synthetic construct
cgacaggaagttgagcagga

SEQ ID NO: 3864 - DNA, 20 bp, Artificial Sequence
  Synthetic construct
gacaggaagttgagcaggac

SEQ ID NO: 3865 - DNA, 20 bp, Artificial Sequence
  Synthetic construct
acaggaagttgagcaggacc

SEQ ID NO: 3866 - DNA, 20 bp, Artificial Sequence
  Synthetic construct
caggaagttgagcaggaccc

SEQ ID NO: 3867 - DNA, 20 bp, Artificial Sequence
  Synthetic construct
aggaagttgagcaggacccc

SEQ ID NO: 3868 - DNA, 20 bp, Artificial Sequence
  Synthetic construct
ggaagttgagcaggaccccg

SEQ ID NO: 3869 - DNA, 20 bp, Artificial Sequence
  Synthetic construct
gaagttgagcaggaccccga

SEQ ID NO: 3870 - DNA, 20 bp, Artificial Sequence
  Synthetic construct
aagttgagcaggaccccgaa

SEQ ID NO: 3871 - DNA, 20 bp, Artificial Sequence
  Synthetic construct
agttgagcaggaccccgaaa

SEQ ID NO: 3872 - DNA, 20 bp, Artificial Sequence
  Synthetic construct
gttgagcaggaccccgaaag

SEQ ID NO: 3873 - DNA, 20 bp, Artificial Sequence
  Synthetic construct
ttgagcaggaccccgaaagg

SEQ ID NO: 3874 - DNA, 20 bp, Artificial Sequence
  Synthetic construct
tgagcaggaccccgaaaggg

SEQ ID NO: 3875 - DNA, 20 bp, Artificial Sequence
  Synthetic construct
gagcaggaccccgaaagggg

SEQ ID NO: 3876 - DNA, 20 bp, Artificial Sequence
  Synthetic construct
agcaggaccccgaaaggggt

SEQ ID NO: 3877 - DNA, 20 bp, Artificial Sequence
  Synthetic construct
gcaggaccccgaaaggggtc

SEQ ID NO: 3878 - DNA, 20 bp, Artificial Sequence
  Synthetic construct
caggaccccgaaaggggtcc

SEQ ID NO: 3879 - DNA, 20 bp, Artificial Sequence
  Synthetic construct
aggaccccgaaaggggtccc

SEQ ID NO: 3880 - DNA, 20 bp, Artificial Sequence
  Synthetic construct
ggaccccgaaaggggtccca

SEQ ID NO: 3881 - DNA, 20 bp, Artificial Sequence
  Synthetic construct
gaccccgaaaggggtcccac

SEQ ID NO: 3882 - DNA, 20 bp, Artificial Sequence
  Synthetic construct
accccgaaaggggtcccacc

SEQ ID NO: 3883 - DNA, 21 bp, Artificial Sequence
  Synthetic construct
tgggtggtaactagccaagca

SEQ ID NO: 3884 - DNA, 21 bp, Artificial Sequence
  Synthetic construct
gggtggtaactagccaagcag

SEQ ID NO: 3885 - DNA, 21 bp, Artificial Sequence
  Synthetic construct
ggtggtaactagccaagcagc

SEQ ID NO: 3886 - DNA, 21 bp, Artificial Sequence
  Synthetic construct
gtggtaactagccaagcagct

SEQ ID NO: 3887 - DNA, 21 bp, Artificial Sequence
  Synthetic construct
tggtaactagccaagcagcta

SEQ ID NO: 3888 - DNA, 21 bp, Artificial Sequence
  Synthetic construct
ggtaactagccaagcagctag

SEQ ID NO: 3889 - DNA, 21 bp, Artificial Sequence
  Synthetic construct
gtaactagccaagcagctagt

SEQ ID NO: 3890 - DNA, 21 bp, Artificial Sequence
  Synthetic construct
taactagccaagcagctagtt

SEQ ID NO: 3891 - DNA, 21 bp, Artificial Sequence
  Synthetic construct
aactagccaagcagctagtta

SEQ ID NO: 3892 - DNA, 21 bp, Artificial Sequence
  Synthetic construct
actagccaagcagctagttac

SEQ ID NO: 3893 - DNA, 21 bp, Artificial Sequence
  Synthetic construct
ctagccaagcagctagttacc

SEQ ID NO: 3894 - DNA, 21 bp, Artificial Sequence
  Synthetic construct
tagccaagcagctagttacca

SEQ ID NO: 3895 - DNA, 21 bp, Artificial Sequence
  Synthetic construct
agccaagcagctagttaccaa

SEQ ID NO: 3896 - DNA, 21 bp, Artificial Sequence
  Synthetic construct
gccaagcagctagttaccaaa

SEQ ID NO: 3897 - DNA, 21 bp, Artificial Sequence
  Synthetic construct
ccaagcagctagttaccaaat

SEQ ID NO: 3898 - DNA, 21 bp, Artificial Sequence
  Synthetic construct
caagcagctagttaccaaatc

SEQ ID NO: 3899 - DNA, 21 bp, Artificial Sequence
  Synthetic construct
aagcagctagttaccaaatcg

SEQ ID NO: 3900 - DNA, 21 bp, Artificial Sequence
  Synthetic construct
agcagctagttaccaaatcgg

SEQ ID NO: 3901 - DNA, 21 bp, Artificial Sequence
  Synthetic construct
gcagctagttaccaaatcggg

SEQ ID NO: 3902 - DNA, 21 bp, Artificial Sequence
  Synthetic construct
cagctagttaccaaatcggga

SEQ ID NO: 3903 - DNA, 21 bp, Artificial Sequence
  Synthetic construct
agctagttaccaaatcgggag

SEQ ID NO: 3904 - DNA, 21 bp, Artificial Sequence
  Synthetic construct
gctagttaccaaatcgggaga

SEQ ID NO: 3905 - DNA, 21 bp, Artificial Sequence
  Synthetic construct
ctagttaccaaatcgggagaa

SEQ ID NO: 3906 - DNA, 21 bp, Artificial Sequence
  Synthetic construct
tagttaccaaatcgggagaat

SEQ ID NO: 3907 - DNA, 21 bp, Artificial Sequence
  Synthetic construct
agttaccaaatcgggagaatc

SEQ ID NO: 3908 - DNA, 21 bp, Artificial Sequence
  Synthetic construct
gttaccaaatcgggagaatcc

SEQ ID NO: 3909 - DNA, 21 bp, Artificial Sequence
  Synthetic construct
ttaccaaatcgggagaatccc

SEQ ID NO: 3910 - DNA, 21 bp, Artificial Sequence
  Synthetic construct
taccaaatcgggagaatcccg

SEQ ID NO: 3911 - DNA, 21 bp, Artificial Sequence
  Synthetic construct
accaaatcgggagaatcccgg

SEQ ID NO: 3912 - DNA, 21 bp, Artificial Sequence
  Synthetic construct
ccaaatcgggagaatcccggg

SEQ ID NO: 3913 - DNA, 21 bp, Artificial Sequence
  Synthetic construct
caaatcgggagaatcccgggt

SEQ ID NO: 3914 - DNA, 21 bp, Artificial Sequence
  Synthetic construct
aaatcgggagaatcccgggtc

SEQ ID NO: 3915 - DNA, 21 bp, Artificial Sequence
  Synthetic construct
aatcgggagaatcccgggtcc

SEQ ID NO: 3916 - DNA, 21 bp, Artificial Sequence
  Synthetic construct
atcgggagaatcccgggtcct

SEQ ID NO: 3917 - DNA, 21 bp, Artificial Sequence
  Synthetic construct
tcgggagaatcccgggtcctc

SEQ ID NO: 3918 - DNA, 21 bp, Artificial Sequence
  Synthetic construct
cgggagaatcccgggtcctct

SEQ ID NO: 3919 - DNA, 21 bp, Artificial Sequence
  Synthetic construct
gggagaatcccgggtcctctc

SEQ ID NO: 3920 - DNA, 21 bp, Artificial Sequence
  Synthetic construct
ggagaatcccgggtcctctct

SEQ ID NO: 3921 - DNA, 21 bp, Artificial Sequence
  Synthetic construct
gagaatcccgggtcctctctt

SEQ ID NO: 3922 - DNA, 21 bp, Artificial Sequence
  Synthetic construct
agaatcccgggtcctctcttt

SEQ ID NO: 3923 - DNA, 21 bp, Artificial Sequence
  Synthetic construct
gaatcccgggtcctctcttta

SEQ ID NO: 3924 - DNA, 21 bp, Artificial Sequence
  Synthetic construct
aatcccgggtcctctctttag

SEQ ID NO: 3925 - DNA, 21 bp, Artificial Sequence
  Synthetic construct
atcccgggtcctctctttagg

SEQ ID NO: 3926 - DNA, 21 bp, Artificial Sequence
  Synthetic construct
tcccgggtcctctctttaggg

SEQ ID NO: 3927 - DNA, 21 bp, Artificial Sequence
  Synthetic construct
cccgggtcctctctttagggg

SEQ ID NO: 3928 - DNA, 21 bp, Artificial Sequence
  Synthetic construct
ccgggtcctctctttaggggg

SEQ ID NO: 3929 - DNA, 21 bp, Artificial Sequence
  Synthetic construct
cgggtcctctctttaggggga

SEQ ID NO: 3930 - DNA, 21 bp, Artificial Sequence
  Synthetic construct
gggtcctctctttagggggag

SEQ ID NO: 3931 - DNA, 21 bp, Artificial Sequence
  Synthetic construct
ggtcctctctttagggggagg

SEQ ID NO: 3932 - DNA, 21 bp, Artificial Sequence
  Synthetic construct
gtcctctctttagggggaggt

SEQ ID NO: 3933 - DNA, 21 bp, Artificial Sequence
  Synthetic construct
tcctctctttagggggaggtc

SEQ ID NO: 3934 - DNA, 21 bp, Artificial Sequence
  Synthetic construct
cctctctttagggggaggtcc

SEQ ID NO: 3935 - DNA, 21 bp, Artificial Sequence
  Synthetic construct
ctctctttagggggaggtccc

SEQ ID NO: 3936 - DNA, 21 bp, Artificial Sequence
  Synthetic construct
tctctttagggggaggtccct

SEQ ID NO: 3937 - DNA, 21 bp, Artificial Sequence
  Synthetic construct
ctctttagggggaggtccctg

SEQ ID NO: 3938 - DNA, 21 bp, Artificial Sequence
  Synthetic construct
tctttagggggaggtccctgg

SEQ ID NO: 3939 - DNA, 21 bp, Artificial Sequence
  Synthetic construct
ctttagggggaggtccctggg

SEQ ID NO: 3940 - DNA, 21 bp, Artificial Sequence
  Synthetic construct
tttagggggaggtccctgggc

SEQ ID NO: 3941 - DNA, 21 bp, Artificial Sequence
  Synthetic construct
ttagggggaggtccctgggcc

SEQ ID NO: 3942 - DNA, 21 bp, Artificial Sequence
  Synthetic construct
tagggggaggtccctgggccg

SEQ ID NO: 3943 - DNA, 21 bp, Artificial Sequence
  Synthetic construct
agggggaggtccctgggccga

SEQ ID NO: 3944 - DNA, 21 bp, Artificial Sequence
  Synthetic construct
gggggaggtccctgggccgaa

SEQ ID NO: 3945 - DNA, 21 bp, Artificial Sequence
  Synthetic construct
ggggaggtccctgggccgaag

SEQ ID NO: 3946 - DNA, 21 bp, Artificial Sequence
  Synthetic construct
gggaggtccctgggccgaagc

SEQ ID NO: 3947 - DNA, 21 bp, Artificial Sequence
  Synthetic construct
ggaggtccctgggccgaagcc

SEQ ID NO: 3948 - DNA, 21 bp, Artificial Sequence
  Synthetic construct
gaggtccctgggccgaagccc

SEQ ID NO: 3949 - DNA, 21 bp, Artificial Sequence
  Synthetic construct
aggtccctgggccgaagcccg

SEQ ID NO: 3950 - DNA, 21 bp, Artificial Sequence
  Synthetic construct
ggtccctgggccgaagcccgc

SEQ ID NO: 3951 - DNA, 21 bp, Artificial Sequence
  Synthetic construct
gtccctgggccgaagcccgcc

SEQ ID NO: 3952 - DNA, 21 bp, Artificial Sequence
  Synthetic construct
tccctgggccgaagcccgccc

SEQ ID NO: 3953 - DNA, 21 bp, Artificial Sequence
  Synthetic construct
ccctgggccgaagcccgccca

SEQ ID NO: 3954 - DNA, 21 bp, Artificial Sequence
  Synthetic construct
cctgggccgaagcccgcccac

SEQ ID NO: 3955 - DNA, 21 bp, Artificial Sequence
  Synthetic construct
ctgggccgaagcccgcccacc

SEQ ID NO: 3956 - DNA, 21 bp, Artificial Sequence
  Synthetic construct
tgggccgaagcccgcccacct

SEQ ID NO: 3957 - DNA, 21 bp, Artificial Sequence
  Synthetic construct
gggccgaagcccgcccacctt

SEQ ID NO: 3958 - DNA, 21 bp, Artificial Sequence
  Synthetic construct
ggccgaagcccgcccaccttt

SEQ ID NO: 3959 - DNA, 21 bp, Artificial Sequence
  Synthetic construct
gccgaagcccgcccacctttc

SEQ ID NO: 3960 - DNA, 21 bp, Artificial Sequence
  Synthetic construct
ccgaagcccgcccacctttcg

SEQ ID NO: 3961 - DNA, 21 bp, Artificial Sequence
  Synthetic construct
cgaagcccgcccacctttcgg

SEQ ID NO: 3962 - DNA, 21 bp, Artificial Sequence
  Synthetic construct
gaagcccgcccacctttcggt

SEQ ID NO: 3963 - DNA, 21 bp, Artificial Sequence
  Synthetic construct
aagcccgcccacctttcggtg

SEQ ID NO: 3964 - DNA, 21 bp, Artificial Sequence
  Synthetic construct
agcccgcccacctttcggtgg

SEQ ID NO: 3965 - DNA, 21 bp, Artificial Sequence
  Synthetic construct
gcccgcccacctttcggtgga

SEQ ID NO: 3966 - DNA, 21 bp, Artificial Sequence
  Synthetic construct
cccgcccacctttcggtggag

SEQ ID NO: 3967 - DNA, 21 bp, Artificial Sequence
  Synthetic construct
ccgcccacctttcggtggagc

SEQ ID NO: 3968 - DNA, 21 bp, Artificial Sequence
  Synthetic construct
cgcccacctttcggtggagcc

SEQ ID NO: 3969 - DNA, 21 bp, Artificial Sequence
  Synthetic construct
gcccacctttcggtggagccg

SEQ ID NO: 3970 - DNA, 21 bp, Artificial Sequence
  Synthetic construct
cccacctttcggtggagccgg

SEQ ID NO: 3971 - DNA, 21 bp, Artificial Sequence
  Synthetic construct
ccacctttcggtggagccgga

SEQ ID NO: 3972 - DNA, 21 bp, Artificial Sequence
  Synthetic construct
cacctttcggtggagccggac

SEQ ID NO: 3973 - DNA, 21 bp, Artificial Sequence
  Synthetic construct
acctttcggtggagccggacc

SEQ ID NO: 3974 - DNA, 21 bp, Artificial Sequence
  Synthetic construct
cctttcggtggagccggaccg

SEQ ID NO: 3975 - DNA, 21 bp, Artificial Sequence
  Synthetic construct
ctttcggtggagccggaccgc

SEQ ID NO: 3976 - DNA, 21 bp, Artificial Sequence
  Synthetic construct
tttcggtggagccggaccgct

SEQ ID NO: 3977 - DNA, 21 bp, Artificial Sequence
  Synthetic construct
ttcggtggagccggaccgctt

SEQ ID NO: 3978 - DNA, 21 bp, Artificial Sequence
  Synthetic construct
tcggtggagccggaccgcttt

SEQ ID NO: 3979 - DNA, 21 bp, Artificial Sequence
  Synthetic construct
cggtggagccggaccgctttc

SEQ ID NO: 3980 - DNA, 21 bp, Artificial Sequence
  Synthetic construct
ggtggagccggaccgctttcg

SEQ ID NO: 3981 - DNA, 21 bp, Artificial Sequence
  Synthetic construct
gtggagccggaccgctttcgc

SEQ ID NO: 3982 - DNA, 21 bp, Artificial Sequence
  Synthetic construct
tggagccggaccgctttcgca

SEQ ID NO: 3983 - DNA, 21 bp, Artificial Sequence
  Synthetic construct
ggagccggaccgctttcgcac

SEQ ID NO: 3984 - DNA, 21 bp, Artificial Sequence
  Synthetic construct
gagccggaccgctttcgcacc

SEQ ID NO: 3985 - DNA, 21 bp, Artificial Sequence
  Synthetic construct
agccggaccgctttcgcaccc

SEQ ID NO: 3986 - DNA, 21 bp, Artificial Sequence
  Synthetic construct
gccggaccgctttcgcacccg

SEQ ID NO: 3987 - DNA, 21 bp, Artificial Sequence
  Synthetic construct
ccggaccgctttcgcacccgt

SEQ ID NO: 3988 - DNA, 21 bp, Artificial Sequence
  Synthetic construct
cggaccgctttcgcacccgtg

SEQ ID NO: 3989 - DNA, 21 bp, Artificial Sequence
  Synthetic construct
ggaccgctttcgcacccgtgc

SEQ ID NO: 3990 - DNA, 21 bp, Artificial Sequence
  Synthetic construct
gaccgctttcgcacccgtgct

SEQ ID NO: 3991 - DNA, 21 bp, Artificial Sequence
  Synthetic construct
accgctttcgcacccgtgctc

SEQ ID NO: 3992 - DNA, 21 bp, Artificial Sequence
  Synthetic construct
ccgctttcgcacccgtgctct

SEQ ID NO: 3993 - DNA, 21 bp, Artificial Sequence
  Synthetic construct
cgctttcgcacccgtgctctt

SEQ ID NO: 3994 - DNA, 21 bp, Artificial Sequence
  Synthetic construct
gctttcgcacccgtgctcttt

SEQ ID NO: 3995 - DNA, 21 bp, Artificial Sequence
  Synthetic construct
ctttcgcacccgtgctctttc

SEQ ID NO: 3996 - DNA, 21 bp, Artificial Sequence
  Synthetic construct
tttcgcacccgtgctctttcg

SEQ ID NO: 3997 - DNA, 21 bp, Artificial Sequence
  Synthetic construct
ttcgcacccgtgctctttcga

SEQ ID NO: 3998 - DNA, 21 bp, Artificial Sequence
  Synthetic construct
tcgcacccgtgctctttcgag

SEQ ID NO: 3999 - DNA, 21 bp, Artificial Sequence
  Synthetic construct
cgcacccgtgctctttcgagc

SEQ ID NO: 4000 - DNA, 21 bp, Artificial Sequence
  Synthetic construct
gcacccgtgctctttcgagca

SEQ ID NO: 4001 - DNA, 21 bp, Artificial Sequence
  Synthetic construct
cacccgtgctctttcgagcac

SEQ ID NO: 4002 - DNA, 21 bp, Artificial Sequence
  Synthetic construct
acccgtgctctttcgagcaca

SEQ ID NO: 4003 - DNA, 21 bp, Artificial Sequence
  Synthetic construct
cccgtgctctttcgagcacac

SEQ ID NO: 4004 - DNA, 21 bp, Artificial Sequence
  Synthetic construct
ccgtgctctttcgagcacacc

SEQ ID NO: 4005 - DNA, 21 bp, Artificial Sequence
  Synthetic construct
cgtgctctttcgagcacaccc

SEQ ID NO: 4006 - DNA, 21 bp, Artificial Sequence
  Synthetic construct
gtgctctttcgagcacaccca

SEQ ID NO: 4007 - DNA, 21 bp, Artificial Sequence
  Synthetic construct
tgctctttcgagcacacccac

SEQ ID NO: 4008 - DNA, 21 bp, Artificial Sequence
  Synthetic construct
gctctttcgagcacacccacc

SEQ ID NO: 4009 - DNA, 21 bp, Artificial Sequence
  Synthetic construct
ctctttcgagcacacccaccc

SEQ ID NO: 4010 - DNA, 21 bp, Artificial Sequence
  Synthetic construct
tctttcgagcacacccacccc

SEQ ID NO: 4011 - DNA, 21 bp, Artificial Sequence
  Synthetic construct
ctttcgagcacacccaccccg

SEQ ID NO: 4012 - DNA, 21 bp, Artificial Sequence
  Synthetic construct
tttcgagcacacccaccccgt

SEQ ID NO: 4013 - DNA, 21 bp, Artificial Sequence
  Synthetic construct
ttcgagcacacccaccccgtt

SEQ ID NO: 4014 - DNA, 21 bp, Artificial Sequence
  Synthetic construct
tcgagcacacccaccccgttt

SEQ ID NO: 4015 - DNA, 21 bp, Artificial Sequence
  Synthetic construct
cgagcacacccaccccgttta

SEQ ID NO: 4016 - DNA, 21 bp, Artificial Sequence
  Synthetic construct
gagcacacccaccccgtttac

SEQ ID NO: 4017 - DNA, 21 bp, Artificial Sequence
  Synthetic construct
agcacacccaccccgtttacg

SEQ ID NO: 4018 - DNA, 21 bp, Artificial Sequence
  Synthetic construct
gcacacccaccccgtttacgg

SEQ ID NO: 4019 - DNA, 21 bp, Artificial Sequence
  Synthetic construct
cacacccaccccgtttacggg

SEQ ID NO: 4020 - DNA, 21 bp, Artificial Sequence
  Synthetic construct
acacccaccccgtttacgggg

SEQ ID NO: 4021 - DNA, 21 bp, Artificial Sequence
  Synthetic construct
cacccaccccgtttacggggg

SEQ ID NO: 4022 - DNA, 21 bp, Artificial Sequence
  Synthetic construct
acccaccccgtttacgggggt

SEQ ID NO: 4023 - DNA, 21 bp, Artificial Sequence
  Synthetic construct
cccaccccgtttacgggggtc

SEQ ID NO: 4024 - DNA, 21 bp, Artificial Sequence
  Synthetic construct
ccaccccgtttacgggggtcc

SEQ ID NO: 4025 - DNA, 21 bp, Artificial Sequence
  Synthetic construct
caccccgtttacgggggtccc

SEQ ID NO: 4026 - DNA, 21 bp, Artificial Sequence
  Synthetic construct
accccgtttacgggggtccct

SEQ ID NO: 4027 - DNA, 21 bp, Artificial Sequence
  Synthetic construct
ccccgtttacgggggtccctc

SEQ ID NO: 4028 - DNA, 21 bp, Artificial Sequence
  Synthetic construct
cccgtttacgggggtccctcg

SEQ ID NO: 4029 - DNA, 21 bp, Artificial Sequence
  Synthetic construct
ccgtttacgggggtccctcgg

SEQ ID NO: 4030 - DNA, 21 bp, Artificial Sequence
  Synthetic construct
cgtttacgggggtccctcggt

SEQ ID NO: 4031 - DNA, 21 bp, Artificial Sequence
  Synthetic construct
gtttacgggggtccctcggtc

SEQ ID NO: 4032 - DNA, 21 bp, Artificial Sequence
  Synthetic construct
tttacgggggtccctcggtca

SEQ ID NO: 4033 - DNA, 21 bp, Artificial Sequence
  Synthetic construct
ttacgggggtccctcggtcag

SEQ ID NO: 4034 - DNA, 21 bp, Artificial Sequence
  Synthetic construct
tacgggggtccctcggtcagc

SEQ ID NO: 4035 - DNA, 21 bp, Artificial Sequence
  Synthetic construct
acgggggtccctcggtcagct

SEQ ID NO: 4036 - DNA, 21 bp, Artificial Sequence
  Synthetic construct
cgggggtccctcggtcagcta

SEQ ID NO: 4037 - DNA, 21 bp, Artificial Sequence
  Synthetic construct
gggggtccctcggtcagctac

SEQ ID NO: 4038 - DNA, 21 bp, Artificial Sequence
  Synthetic construct
ggggtccctcggtcagctacc

SEQ ID NO: 4039 - DNA, 21 bp, Artificial Sequence
  Synthetic construct
gggtccctcggtcagctaccg

SEQ ID NO: 4040 - DNA, 21 bp, Artificial Sequence
  Synthetic construct
ggtccctcggtcagctaccga

SEQ ID NO: 4041 - DNA, 21 bp, Artificial Sequence
  Synthetic construct
gtccctcggtcagctaccgag

SEQ ID NO: 4042 - DNA, 21 bp, Artificial Sequence
  Synthetic construct
tccctcggtcagctaccgagg

SEQ ID NO: 4043 - DNA, 21 bp, Artificial Sequence
  Synthetic construct
ccctcggtcagctaccgagga

SEQ ID NO: 4044 - DNA, 21 bp, Artificial Sequence
  Synthetic construct
cctcggtcagctaccgaggag

SEQ ID NO: 4045 - DNA, 21 bp, Artificial Sequence
  Synthetic construct
ctcggtcagctaccgaggaga

SEQ ID NO: 4046 - DNA, 21 bp, Artificial Sequence
  Synthetic construct
tcggtcagctaccgaggagag

SEQ ID NO: 4047 - DNA, 21 bp, Artificial Sequence
  Synthetic construct
cggtcagctaccgaggagagc

SEQ ID NO: 4048 - DNA, 21 bp, Artificial Sequence
  Synthetic construct
ggtcagctaccgaggagagct

SEQ ID NO: 4049 - DNA, 21 bp, Artificial Sequence
  Synthetic construct
gtcagctaccgaggagagctc

SEQ ID NO: 4050 - DNA, 21 bp, Artificial Sequence
  Synthetic construct
tcagctaccgaggagagctcg

SEQ ID NO: 4051 - DNA, 21 bp, Artificial Sequence
  Synthetic construct
cagctaccgaggagagctcgc

SEQ ID NO: 4052 - DNA, 21 bp, Artificial Sequence
  Synthetic construct
agctaccgaggagagctcgct

SEQ ID NO: 4053 - DNA, 21 bp, Artificial Sequence
  Synthetic construct
gctaccgaggagagctcgctg

SEQ ID NO: 4054 - DNA, 21 bp, Artificial Sequence
  Synthetic construct
ctaccgaggagagctcgctgg

SEQ ID NO: 4055 - DNA, 21 bp, Artificial Sequence
  Synthetic construct
taccgaggagagctcgctggc

SEQ ID NO: 4056 - DNA, 21 bp, Artificial Sequence
  Synthetic construct
accgaggagagctcgctggcc

SEQ ID NO: 4057 - DNA, 21 bp, Artificial Sequence
  Synthetic construct
ccgaggagagctcgctggccc

SEQ ID NO: 4058 - DNA, 21 bp, Artificial Sequence
  Synthetic construct
cgaggagagctcgctggccca

SEQ ID NO: 4059 - DNA, 21 bp, Artificial Sequence
  Synthetic construct
gaggagagctcgctggcccac

SEQ ID NO: 4060 - DNA, 21 bp, Artificial Sequence
  Synthetic construct
aggagagctcgctggcccaca

SEQ ID NO: 4061 - DNA, 21 bp, Artificial Sequence
  Synthetic construct
ggagagctcgctggcccacac

SEQ ID NO: 4062 - DNA, 21 bp, Artificial Sequence
  Synthetic construct
gagagctcgctggcccacact

SEQ ID NO: 4063 - DNA, 21 bp, Artificial Sequence
  Synthetic construct
agagctcgctggcccacactc

SEQ ID NO: 4064 - DNA, 21 bp, Artificial Sequence
  Synthetic construct
gagctcgctggcccacactcc

SEQ ID NO: 4065 - DNA, 21 bp, Artificial Sequence
  Synthetic construct
agctcgctggcccacactcct

SEQ ID NO: 4066 - DNA, 21 bp, Artificial Sequence
  Synthetic construct
gctcgctggcccacactcctg

SEQ ID NO: 4067 - DNA, 21 bp, Artificial Sequence
  Synthetic construct
ctcgctggcccacactcctga

SEQ ID NO: 4068 - DNA, 21 bp, Artificial Sequence
  Synthetic construct
tcgctggcccacactcctgag

SEQ ID NO: 4069 - DNA, 21 bp, Artificial Sequence
  Synthetic construct
cgctggcccacactcctgagg

SEQ ID NO: 4070 - DNA, 21 bp, Artificial Sequence
  Synthetic construct
gctggcccacactcctgaggg

SEQ ID NO: 4071 - DNA, 21 bp, Artificial Sequence
  Synthetic construct
ctggcccacactcctgaggga

SEQ ID NO: 4072 - DNA, 21 bp, Artificial Sequence
  Synthetic construct
tggcccacactcctgagggaa

SEQ ID NO: 4073 - DNA, 21 bp, Artificial Sequence
  Synthetic construct
ggcccacactcctgagggaat

SEQ ID NO: 4074 - DNA, 21 bp, Artificial Sequence
  Synthetic construct
gcccacactcctgagggaatg

SEQ ID NO: 4075 - DNA, 21 bp, Artificial Sequence
  Synthetic construct
cccacactcctgagggaatgt

SEQ ID NO: 4076 - DNA, 21 bp, Artificial Sequence
  Synthetic construct
ccacactcctgagggaatgtg

SEQ ID NO: 4077 - DNA, 21 bp, Artificial Sequence
  Synthetic construct
cacactcctgagggaatgtgg

SEQ ID NO: 4078 - DNA, 21 bp, Artificial Sequence
  Synthetic construct
acactcctgagggaatgtggg

SEQ ID NO: 4079 - DNA, 21 bp, Artificial Sequence
  Synthetic construct
cactcctgagggaatgtggga

SEQ ID NO: 4080 - DNA, 21 bp, Artificial Sequence
  Synthetic construct
actcctgagggaatgtgggaa

SEQ ID NO: 4081 - DNA, 21 bp, Artificial Sequence
  Synthetic construct
ctcctgagggaatgtgggaac

SEQ ID NO: 4082 - DNA, 21 bp, Artificial Sequence
  Synthetic construct
tcctgagggaatgtgggaacc

SEQ ID NO: 4083 - DNA, 21 bp, Artificial Sequence
  Synthetic construct
cctgagggaatgtgggaaccg

SEQ ID NO: 4084 - DNA, 21 bp, Artificial Sequence
  Synthetic construct
ctgagggaatgtgggaaccgg

SEQ ID NO: 4085 - DNA, 21 bp, Artificial Sequence
  Synthetic construct
tgagggaatgtgggaaccggc

SEQ ID NO: 4086 - DNA, 21 bp, Artificial Sequence
  Synthetic construct
gagggaatgtgggaaccggcg

SEQ ID NO: 4087 - DNA, 21 bp, Artificial Sequence
  Synthetic construct
agggaatgtgggaaccggcgt

SEQ ID NO: 4088 - DNA, 21 bp, Artificial Sequence
  Synthetic construct
gggaatgtgggaaccggcgtt

SEQ ID NO: 4089 - DNA, 21 bp, Artificial Sequence
  Synthetic construct
ggaatgtgggaaccggcgtta

SEQ ID NO: 4090 - DNA, 21 bp, Artificial Sequence
  Synthetic construct
gaatgtgggaaccggcgttag

SEQ ID NO: 4091 - DNA, 21 bp, Artificial Sequence
  Synthetic construct
aatgtgggaaccggcgttagc

SEQ ID NO: 4092 - DNA, 21 bp, Artificial Sequence
  Synthetic construct
atgtgggaaccggcgttagcc

SEQ ID NO: 4093 - DNA, 21 bp, Artificial Sequence
  Synthetic construct
tgtgggaaccggcgttagcca

SEQ ID NO: 4094 - DNA, 21 bp, Artificial Sequence
  Synthetic construct
gtgggaaccggcgttagccac

SEQ ID NO: 4095 - DNA, 21 bp, Artificial Sequence
  Synthetic construct
tgggaaccggcgttagccact

SEQ ID NO: 4096 - DNA, 21 bp, Artificial Sequence
  Synthetic construct
gggaaccggcgttagccactc

SEQ ID NO: 4097 - DNA, 21 bp, Artificial Sequence
  Synthetic construct
ggaaccggcgttagccactcc

SEQ ID NO: 4098 - DNA, 21 bp, Artificial Sequence
  Synthetic construct
gaaccggcgttagccactccg

SEQ ID NO: 4099 - DNA, 21 bp, Artificial Sequence
  Synthetic construct
aaccggcgttagccactccga

SEQ ID NO: 4100 - DNA, 21 bp, Artificial Sequence
  Synthetic construct
accggcgttagccactccgaa

SEQ ID NO: 4101 - DNA, 21 bp, Artificial Sequence
  Synthetic construct
ccggcgttagccactccgaag

SEQ ID NO: 4102 - DNA, 21 bp, Artificial Sequence
  Synthetic construct
cggcgttagccactccgaagt

SEQ ID NO: 4103 - DNA, 21 bp, Artificial Sequence
  Synthetic construct
ggcgttagccactccgaagtg

SEQ ID NO: 4104 - DNA, 21 bp, Artificial Sequence
  Synthetic construct
gcgttagccactccgaagtgc

SEQ ID NO: 4105 - DNA, 21 bp, Artificial Sequence
  Synthetic construct
cgttagccactccgaagtgcg

SEQ ID NO: 4106 - DNA, 21 bp, Artificial Sequence
  Synthetic construct
gttagccactccgaagtgcgt

SEQ ID NO: 4107 - DNA, 21 bp, Artificial Sequence
  Synthetic construct
ttagccactccgaagtgcgta

SEQ ID NO: 4108 - DNA, 21 bp, Artificial Sequence
  Synthetic construct
tagccactccgaagtgcgtat

SEQ ID NO: 4109 - DNA, 21 bp, Artificial Sequence
  Synthetic construct
agccactccgaagtgcgtata

SEQ ID NO: 4110 - DNA, 21 bp, Artificial Sequence
  Synthetic construct
gccactccgaagtgcgtataa

SEQ ID NO: 4111 - DNA, 21 bp, Artificial Sequence
  Synthetic construct
ccactccgaagtgcgtataac

SEQ ID NO: 4112 - DNA, 21 bp, Artificial Sequence
  Synthetic construct
cactccgaagtgcgtataacg

SEQ ID NO: 4113 - DNA, 21 bp, Artificial Sequence
  Synthetic construct
actccgaagtgcgtataacgc

SEQ ID NO: 4114 - DNA, 21 bp, Artificial Sequence
  Synthetic construct
ctccgaagtgcgtataacgcg

SEQ ID NO: 4115 - DNA, 21 bp, Artificial Sequence
  Synthetic construct
tccgaagtgcgtataacgcgc

SEQ ID NO: 4116 - DNA, 21 bp, Artificial Sequence
  Synthetic construct
ccgaagtgcgtataacgcgca

SEQ ID NO: 4117 - DNA, 21 bp, Artificial Sequence
  Synthetic construct
cgaagtgcgtataacgcgcac

SEQ ID NO: 4118 - DNA, 21 bp, Artificial Sequence
  Synthetic construct
gaagtgcgtataacgcgcacg

SEQ ID NO: 4119 - DNA, 21 bp, Artificial Sequence
  Synthetic construct
aagtgcgtataacgcgcacgc

SEQ ID NO: 4120 - DNA, 21 bp, Artificial Sequence
  Synthetic construct
agtgcgtataacgcgcacgcc

SEQ ID NO: 4121 - DNA, 21 bp, Artificial Sequence
  Synthetic construct
gtgcgtataacgcgcacgccg

SEQ ID NO: 4122 - DNA, 21 bp, Artificial Sequence
  Synthetic construct
tgcgtataacgcgcacgccgg

SEQ ID NO: 4123 - DNA, 21 bp, Artificial Sequence
  Synthetic construct
gcgtataacgcgcacgccggc

SEQ ID NO: 4124 - DNA, 21 bp, Artificial Sequence
  Synthetic construct
cgtataacgcgcacgccggcg

SEQ ID NO: 4125 - DNA, 21 bp, Artificial Sequence
  Synthetic construct
gtataacgcgcacgccggcgg

SEQ ID NO: 4126 - DNA, 21 bp, Artificial Sequence
  Synthetic construct
tataacgcgcacgccggcgga

SEQ ID NO: 4127 - DNA, 21 bp, Artificial Sequence
  Synthetic construct
ataacgcgcacgccggcggac

SEQ ID NO: 4128 - DNA, 21 bp, Artificial Sequence
  Synthetic construct
taacgcgcacgccggcggact

SEQ ID NO: 4129 - DNA, 21 bp, Artificial Sequence
  Synthetic construct
aacgcgcacgccggcggactt

SEQ ID NO: 4130 - DNA, 21 bp, Artificial Sequence
  Synthetic construct
acgcgcacgccggcggacttc

SEQ ID NO: 4131 - DNA, 21 bp, Artificial Sequence
  Synthetic construct
cgcgcacgccggcggacttca

SEQ ID NO: 4132 - DNA, 21 bp, Artificial Sequence
  Synthetic construct
gcgcacgccggcggacttcat

SEQ ID NO: 4133 - DNA, 21 bp, Artificial Sequence
  Synthetic construct
cgcacgccggcggacttcatg

SEQ ID NO: 4134 - DNA, 21 bp, Artificial Sequence
  Synthetic construct
gcacgccggcggacttcatgc

SEQ ID NO: 4135 - DNA, 21 bp, Artificial Sequence
  Synthetic construct
cacgccggcggacttcatgct

SEQ ID NO: 4136 - DNA, 21 bp, Artificial Sequence
  Synthetic construct
acgccggcggacttcatgctg

SEQ ID NO: 4137 - DNA, 21 bp, Artificial Sequence
  Synthetic construct
cgccggcggacttcatgctgt

SEQ ID NO: 4138 - DNA, 21 bp, Artificial Sequence
  Synthetic construct
gccggcggacttcatgctgtc

SEQ ID NO: 4139 - DNA, 21 bp, Artificial Sequence
  Synthetic construct
ccggcggacttcatgctgtcg

SEQ ID NO: 4140 - DNA, 21 bp, Artificial Sequence
  Synthetic construct
cggcggacttcatgctgtcgg

SEQ ID NO: 4141 - DNA, 21 bp, Artificial Sequence
  Synthetic construct
ggcggacttcatgctgtcggt

SEQ ID NO: 4142 - DNA, 21 bp, Artificial Sequence
  Synthetic construct
gcggacttcatgctgtcggtg

SEQ ID NO: 4143 - DNA, 21 bp, Artificial Sequence
  Synthetic construct
cggacttcatgctgtcggtga

SEQ ID NO: 4144 - DNA, 21 bp, Artificial Sequence
  Synthetic construct
ggacttcatgctgtcggtgat

SEQ ID NO: 4145 - DNA, 21 bp, Artificial Sequence
  Synthetic construct
gacttcatgctgtcggtgatt

SEQ ID NO: 4146 - DNA, 21 bp, Artificial Sequence
  Synthetic construct
acttcatgctgtcggtgattt

SEQ ID NO: 4147 - DNA, 21 bp, Artificial Sequence
  Synthetic construct
cttcatgctgtcggtgatttc

SEQ ID NO: 4148 - DNA, 21 bp, Artificial Sequence
  Synthetic construct
ttcatgctgtcggtgatttca

SEQ ID NO: 4149 - DNA, 21 bp, Artificial Sequence
  Synthetic construct
tcatgctgtcggtgatttcac

SEQ ID NO: 4150 - DNA, 21 bp, Artificial Sequence
  Synthetic construct
catgctgtcggtgatttcacc

SEQ ID NO: 4151 - DNA, 21 bp, Artificial Sequence
  Synthetic construct
atgctgtcggtgatttcacct

SEQ ID NO: 4152 - DNA, 21 bp, Artificial Sequence
  Synthetic construct
tgctgtcggtgatttcacctc

SEQ ID NO: 4153 - DNA, 21 bp, Artificial Sequence
  Synthetic construct
gctgtcggtgatttcacctcc

SEQ ID NO: 4154 - DNA, 21 bp, Artificial Sequence
  Synthetic construct
ctgtcggtgatttcacctcca

SEQ ID NO: 4155 - DNA, 21 bp, Artificial Sequence
  Synthetic construct
tgtcggtgatttcacctccag

SEQ ID NO: 4156 - DNA, 21 bp, Artificial Sequence
  Synthetic construct
gtcggtgatttcacctccagt

SEQ ID NO: 4157 - DNA, 21 bp, Artificial Sequence
  Synthetic construct
tcggtgatttcacctccagta

SEQ ID NO: 4158 - DNA, 21 bp, Artificial Sequence
  Synthetic construct
cggtgatttcacctccagtat

SEQ ID NO: 4159 - DNA, 21 bp, Artificial Sequence
  Synthetic construct
ggtgatttcacctccagtatg

SEQ ID NO: 4160 - DNA, 21 bp, Artificial Sequence
  Synthetic construct
gtgatttcacctccagtatgg

SEQ ID NO: 4161 - DNA, 21 bp, Artificial Sequence
  Synthetic construct
tgatttcacctccagtatgga

SEQ ID NO: 4162 - DNA, 21 bp, Artificial Sequence
  Synthetic construct
gatttcacctccagtatggaa

SEQ ID NO: 4163 - DNA, 21 bp, Artificial Sequence
  Synthetic construct
atttcacctccagtatggaac

SEQ ID NO: 4164 - DNA, 21 bp, Artificial Sequence
  Synthetic construct
tttcacctccagtatggaacc

SEQ ID NO: 4165 - DNA, 21 bp, Artificial Sequence
  Synthetic construct
ttcacctccagtatggaacca

SEQ ID NO: 4166 - DNA, 21 bp, Artificial Sequence
  Synthetic construct
tcacctccagtatggaaccac

SEQ ID NO: 4167 - DNA, 21 bp, Artificial Sequence
  Synthetic construct
cacctccagtatggaaccacg

SEQ ID NO: 4168 - DNA, 21 bp, Artificial Sequence
  Synthetic construct
acctccagtatggaaccacgc

SEQ ID NO: 4169 - DNA, 21 bp, Artificial Sequence
  Synthetic construct
cctccagtatggaaccacgct

SEQ ID NO: 4170 - DNA, 21 bp, Artificial Sequence
  Synthetic construct
ctccagtatggaaccacgcta

SEQ ID NO: 4171 - DNA, 21 bp, Artificial Sequence
  Synthetic construct
tccagtatggaaccacgctat

SEQ ID NO: 4172 - DNA, 21 bp, Artificial Sequence
  Synthetic construct
ccagtatggaaccacgctatg

SEQ ID NO: 4173 - DNA, 21 bp, Artificial Sequence
  Synthetic construct
cagtatggaaccacgctatgt

SEQ ID NO: 4174 - DNA, 21 bp, Artificial Sequence
  Synthetic construct
agtatggaaccacgctatgta

SEQ ID NO: 4175 - DNA, 21 bp, Artificial Sequence
  Synthetic construct
gtatggaaccacgctatgtag

SEQ ID NO: 4176 - DNA, 21 bp, Artificial Sequence
  Synthetic construct
tatggaaccacgctatgtagc

SEQ ID NO: 4177 - DNA, 21 bp, Artificial Sequence
  Synthetic construct
atggaaccacgctatgtagcg

SEQ ID NO: 4178 - DNA, 21 bp, Artificial Sequence
  Synthetic construct
tggaaccacgctatgtagcga

SEQ ID NO: 4179 - DNA, 21 bp, Artificial Sequence
  Synthetic construct
ggaaccacgctatgtagcgac

SEQ ID NO: 4180 - DNA, 21 bp, Artificial Sequence
  Synthetic construct
gaaccacgctatgtagcgacc

SEQ ID NO: 4181 - DNA, 21 bp, Artificial Sequence
  Synthetic construct
aaccacgctatgtagcgacca

SEQ ID NO: 4182 - DNA, 21 bp, Artificial Sequence
  Synthetic construct
accacgctatgtagcgaccac

SEQ ID NO: 4183 - DNA, 21 bp, Artificial Sequence
  Synthetic construct
ccacgctatgtagcgaccact

SEQ ID NO: 4184 - DNA, 21 bp, Artificial Sequence
  Synthetic construct
cacgctatgtagcgaccactg

SEQ ID NO: 4185 - DNA, 21 bp, Artificial Sequence
  Synthetic construct
acgctatgtagcgaccactgt

SEQ ID NO: 4186 - DNA, 21 bp, Artificial Sequence
  Synthetic construct
cgctatgtagcgaccactgtc

SEQ ID NO: 4187 - DNA, 21 bp, Artificial Sequence
  Synthetic construct
gctatgtagcgaccactgtcg

SEQ ID NO: 4188 - DNA, 21 bp, Artificial Sequence
  Synthetic construct
ctatgtagcgaccactgtcgt

SEQ ID NO: 4189 - DNA, 21 bp, Artificial Sequence
  Synthetic construct
tatgtagcgaccactgtcgtg

SEQ ID NO: 4190 - DNA, 21 bp, Artificial Sequence
  Synthetic construct
atgtagcgaccactgtcgtgc

SEQ ID NO: 4191 - DNA, 21 bp, Artificial Sequence
  Synthetic construct
tgtagcgaccactgtcgtgct

SEQ ID NO: 4192 - DNA, 21 bp, Artificial Sequence
  Synthetic construct
gtagcgaccactgtcgtgctt

SEQ ID NO: 4193 - DNA, 21 bp, Artificial Sequence
  Synthetic construct
tagcgaccactgtcgtgcttt

SEQ ID NO: 4194 - DNA, 21 bp, Artificial Sequence
  Synthetic construct
agcgaccactgtcgtgctttt

SEQ ID NO: 4195 - DNA, 21 bp, Artificial Sequence
  Synthetic construct
gcgaccactgtcgtgcttttc

SEQ ID NO: 4196 - DNA, 21 bp, Artificial Sequence
  Synthetic construct
cgaccactgtcgtgcttttcg

SEQ ID NO: 4197 - DNA, 21 bp, Artificial Sequence
  Synthetic construct
gaccactgtcgtgcttttcgc

SEQ ID NO: 4198 - DNA, 21 bp, Artificial Sequence
  Synthetic construct
accactgtcgtgcttttcgct

SEQ ID NO: 4199 - DNA, 21 bp, Artificial Sequence
  Synthetic construct
ccactgtcgtgcttttcgctg

SEQ ID NO: 4200 - DNA, 21 bp, Artificial Sequence
  Synthetic construct
cactgtcgtgcttttcgctga

SEQ ID NO: 4201 - DNA, 21 bp, Artificial Sequence
  Synthetic construct
actgtcgtgcttttcgctgaa

SEQ ID NO: 4202 - DNA, 21 bp, Artificial Sequence
  Synthetic construct
ctgtcgtgcttttcgctgaag

SEQ ID NO: 4203 - DNA, 21 bp, Artificial Sequence
  Synthetic construct
tgtcgtgcttttcgctgaaga

SEQ ID NO: 4204 - DNA, 21 bp, Artificial Sequence
  Synthetic construct
gtcgtgcttttcgctgaagaa

SEQ ID NO: 4205 - DNA, 21 bp, Artificial Sequence
  Synthetic construct
tcgtgcttttcgctgaagaac

SEQ ID NO: 4206 - DNA, 21 bp, Artificial Sequence
  Synthetic construct
cgtgcttttcgctgaagaact

SEQ ID NO: 4207 - DNA, 21 bp, Artificial Sequence
  Synthetic construct
gtgcttttcgctgaagaactt

SEQ ID NO: 4208 - DNA, 21 bp, Artificial Sequence
  Synthetic construct
tgcttttcgctgaagaacttg

SEQ ID NO: 4209 - DNA, 21 bp, Artificial Sequence
  Synthetic construct
gcttttcgctgaagaacttgc

SEQ ID NO: 4210 - DNA, 21 bp, Artificial Sequence
  Synthetic construct
cttttcgctgaagaacttgcg

SEQ ID NO: 4211 - DNA, 21 bp, Artificial Sequence
  Synthetic construct
ttttcgctgaagaacttgcgt

SEQ ID NO: 4212 - DNA, 21 bp, Artificial Sequence
  Synthetic construct
tttcgctgaagaacttgcgtt

SEQ ID NO: 4213 - DNA, 21 bp, Artificial Sequence
  Synthetic construct
ttcgctgaagaacttgcgttc

SEQ ID NO: 4214 - DNA, 21 bp, Artificial Sequence
  Synthetic construct
tcgctgaagaacttgcgttct

SEQ ID NO: 4215 - DNA, 21 bp, Artificial Sequence
  Synthetic construct
cgctgaagaacttgcgttctc

SEQ ID NO: 4216 - DNA, 21 bp, Artificial Sequence
  Synthetic construct
gctgaagaacttgcgttctcg

SEQ ID NO: 4217 - DNA, 21 bp, Artificial Sequence
  Synthetic construct
ctgaagaacttgcgttctcga

SEQ ID NO: 4218 - DNA, 21 bp, Artificial Sequence
  Synthetic construct
tgaagaacttgcgttctcgag

SEQ ID NO: 4219 - DNA, 21 bp, Artificial Sequence
  Synthetic construct
gaagaacttgcgttctcgagc

SEQ ID NO: 4220 - DNA, 21 bp, Artificial Sequence
  Synthetic construct
aagaacttgcgttctcgagcg

SEQ ID NO: 4221 - DNA, 21 bp, Artificial Sequence
  Synthetic construct
agaacttgcgttctcgagcga

SEQ ID NO: 4222 - DNA, 21 bp, Artificial Sequence
  Synthetic construct
gaacttgcgttctcgagcgat

SEQ ID NO: 4223 - DNA, 21 bp, Artificial Sequence
  Synthetic construct
aacttgcgttctcgagcgata

SEQ ID NO: 4224 - DNA, 21 bp, Artificial Sequence
  Synthetic construct
acttgcgttctcgagcgatac

SEQ ID NO: 4225 - DNA, 21 bp, Artificial Sequence
  Synthetic construct
cttgcgttctcgagcgatacg

SEQ ID NO: 4226 - DNA, 21 bp, Artificial Sequence
  Synthetic construct
ttgcgttctcgagcgatacga

SEQ ID NO: 4227 - DNA, 21 bp, Artificial Sequence
  Synthetic construct
tgcgttctcgagcgatacgag

SEQ ID NO: 4228 - DNA, 21 bp, Artificial Sequence
  Synthetic construct
gcgttctcgagcgatacgagc

SEQ ID NO: 4229 - DNA, 21 bp, Artificial Sequence
  Synthetic construct
cgttctcgagcgatacgagca

SEQ ID NO: 4230 - DNA, 21 bp, Artificial Sequence
  Synthetic construct
gttctcgagcgatacgagcaa

SEQ ID NO: 4231 - DNA, 21 bp, Artificial Sequence
  Synthetic construct
ttctcgagcgatacgagcaag

SEQ ID NO: 4232 - DNA, 21 bp, Artificial Sequence
  Synthetic construct
tctcgagcgatacgagcaaga

SEQ ID NO: 4233 - DNA, 21 bp, Artificial Sequence
  Synthetic construct
ctcgagcgatacgagcaagac

SEQ ID NO: 4234 - DNA, 21 bp, Artificial Sequence
  Synthetic construct
tcgagcgatacgagcaagacg

SEQ ID NO: 4235 - DNA, 21 bp, Artificial Sequence
  Synthetic construct
cgagcgatacgagcaagacgg

SEQ ID NO: 4236 - DNA, 21 bp, Artificial Sequence
  Synthetic construct
gagcgatacgagcaagacgga

SEQ ID NO: 4237 - DNA, 21 bp, Artificial Sequence
  Synthetic construct
agcgatacgagcaagacggaa

SEQ ID NO: 4238 - DNA, 21 bp, Artificial Sequence
  Synthetic construct
gcgatacgagcaagacggaaa

SEQ ID NO: 4239 - DNA, 21 bp, Artificial Sequence
  Synthetic construct
cgatacgagcaagacggaaac

SEQ ID NO: 4240 - DNA, 21 bp, Artificial Sequence
  Synthetic construct
gatacgagcaagacggaaacc

SEQ ID NO: 4241 - DNA, 21 bp, Artificial Sequence
  Synthetic construct
atacgagcaagacggaaaccc

SEQ ID NO: 4242 - DNA, 21 bp, Artificial Sequence
  Synthetic construct
tacgagcaagacggaaacccg

SEQ ID NO: 4243 - DNA, 21 bp, Artificial Sequence
  Synthetic construct
acgagcaagacggaaacccga

SEQ ID NO: 4244 - DNA, 21 bp, Artificial Sequence
  Synthetic construct
cgagcaagacggaaacccgag

SEQ ID NO: 4245 - DNA, 21 bp, Artificial Sequence
  Synthetic construct
gagcaagacggaaacccgagg

SEQ ID NO: 4246 - DNA, 21 bp, Artificial Sequence
  Synthetic construct
agcaagacggaaacccgaggt

SEQ ID NO: 4247 - DNA, 21 bp, Artificial Sequence
  Synthetic construct
gcaagacggaaacccgaggta

SEQ ID NO: 4248 - DNA, 21 bp, Artificial Sequence
  Synthetic construct
caagacggaaacccgaggtac

SEQ ID NO: 4249 - DNA, 21 bp, Artificial Sequence
  Synthetic construct
aagacggaaacccgaggtacg

SEQ ID NO: 4250 - DNA, 21 bp, Artificial Sequence
  Synthetic construct
agacggaaacccgaggtacgg

SEQ ID NO: 4251 - DNA, 21 bp, Artificial Sequence
  Synthetic construct
gacggaaacccgaggtacggg

SEQ ID NO: 4252 - DNA, 21 bp, Artificial Sequence
  Synthetic construct
acggaaacccgaggtacgggt

SEQ ID NO: 4253 - DNA, 21 bp, Artificial Sequence
  Synthetic construct
cggaaacccgaggtacgggta

SEQ ID NO: 4254 - DNA, 21 bp, Artificial Sequence
  Synthetic construct
ggaaacccgaggtacgggtat

SEQ ID NO: 4255 - DNA, 21 bp, Artificial Sequence
  Synthetic construct
gaaacccgaggtacgggtatc

SEQ ID NO: 4256 - DNA, 21 bp, Artificial Sequence
  Synthetic construct
aaacccgaggtacgggtatcc

SEQ ID NO: 4257 - DNA, 21 bp, Artificial Sequence
  Synthetic construct
aacccgaggtacgggtatccg

SEQ ID NO: 4258 - DNA, 21 bp, Artificial Sequence
  Synthetic construct
acccgaggtacgggtatccgc

SEQ ID NO: 4259 - DNA, 21 bp, Artificial Sequence
  Synthetic construct
cccgaggtacgggtatccgcg

SEQ ID NO: 4260 - DNA, 21 bp, Artificial Sequence
  Synthetic construct
ccgaggtacgggtatccgcga

SEQ ID NO: 4261 - DNA, 21 bp, Artificial Sequence
  Synthetic construct
cgaggtacgggtatccgcgag

SEQ ID NO: 4262 - DNA, 21 bp, Artificial Sequence
  Synthetic construct
gaggtacgggtatccgcgagc

SEQ ID NO: 4263 - DNA, 21 bp, Artificial Sequence
  Synthetic construct
aggtacgggtatccgcgagca

SEQ ID NO: 4264 - DNA, 21 bp, Artificial Sequence
  Synthetic construct
ggtacgggtatccgcgagcag

SEQ ID NO: 4265 - DNA, 21 bp, Artificial Sequence
  Synthetic construct
gtacgggtatccgcgagcagc

SEQ ID NO: 4266 - DNA, 21 bp, Artificial Sequence
  Synthetic construct
tacgggtatccgcgagcagcc

SEQ ID NO: 4267 - DNA, 21 bp, Artificial Sequence
  Synthetic construct
acgggtatccgcgagcagccg

SEQ ID NO: 4268 - DNA, 21 bp, Artificial Sequence
  Synthetic construct
cgggtatccgcgagcagccgc

SEQ ID NO: 4269 - DNA, 21 bp, Artificial Sequence
  Synthetic construct
gggtatccgcgagcagccgcc

SEQ ID NO: 4270 - DNA, 21 bp, Artificial Sequence
  Synthetic construct
ggtatccgcgagcagccgccc

SEQ ID NO: 4271 - DNA, 21 bp, Artificial Sequence
  Synthetic construct
gtatccgcgagcagccgcccg

SEQ ID NO: 4272 - DNA, 21 bp, Artificial Sequence
  Synthetic construct
tatccgcgagcagccgcccgt

SEQ ID NO: 4273 - DNA, 21 bp, Artificial Sequence
  Synthetic construct
atccgcgagcagccgcccgta

SEQ ID NO: 4274 - DNA, 21 bp, Artificial Sequence
  Synthetic construct
tccgcgagcagccgcccgtac

SEQ ID NO: 4275 - DNA, 21 bp, Artificial Sequence
  Synthetic construct
ccgcgagcagccgcccgtacg

SEQ ID NO: 4276 - DNA, 21 bp, Artificial Sequence
  Synthetic construct
cgcgagcagccgcccgtacgg

SEQ ID NO: 4277 - DNA, 21 bp, Artificial Sequence
  Synthetic construct
gcgagcagccgcccgtacgga

SEQ ID NO: 4278 - DNA, 21 bp, Artificial Sequence
  Synthetic construct
cgagcagccgcccgtacggag

SEQ ID NO: 4279 - DNA, 21 bp, Artificial Sequence
  Synthetic construct
gagcagccgcccgtacggagt

SEQ ID NO: 4280 - DNA, 21 bp, Artificial Sequence
  Synthetic construct
agcagccgcccgtacggagtc

SEQ ID NO: 4281 - DNA, 21 bp, Artificial Sequence
  Synthetic construct
gcagccgcccgtacggagtct

SEQ ID NO: 4282 - DNA, 21 bp, Artificial Sequence
  Synthetic construct
cagccgcccgtacggagtctt

SEQ ID NO: 4283 - DNA, 21 bp, Artificial Sequence
  Synthetic construct
agccgcccgtacggagtcttg

SEQ ID NO: 4284 - DNA, 21 bp, Artificial Sequence
  Synthetic construct
gccgcccgtacggagtcttgg

SEQ ID NO: 4285 - DNA, 21 bp, Artificial Sequence
  Synthetic construct
ccgcccgtacggagtcttggt

SEQ ID NO: 4286 - DNA, 21 bp, Artificial Sequence
  Synthetic construct
cgcccgtacggagtcttggtg

SEQ ID NO: 4287 - DNA, 21 bp, Artificial Sequence
  Synthetic construct
gcccgtacggagtcttggtgt

SEQ ID NO: 4288 - DNA, 21 bp, Artificial Sequence
  Synthetic construct
cccgtacggagtcttggtgta

SEQ ID NO: 4289 - DNA, 21 bp, Artificial Sequence
  Synthetic construct
ccgtacggagtcttggtgtat

SEQ ID NO: 4290 - DNA, 21 bp, Artificial Sequence
  Synthetic construct
cgtacggagtcttggtgtata

SEQ ID NO: 4291 - DNA, 21 bp, Artificial Sequence
  Synthetic construct
gtacggagtcttggtgtatac

SEQ ID NO: 4292 - DNA, 21 bp, Artificial Sequence
  Synthetic construct
tacggagtcttggtgtatacc

SEQ ID NO: 4293 - DNA, 21 bp, Artificial Sequence
  Synthetic construct
acggagtcttggtgtataccg

SEQ ID NO: 4294 - DNA, 21 bp, Artificial Sequence
  Synthetic construct
cggagtcttggtgtataccga

SEQ ID NO: 4295 - DNA, 21 bp, Artificial Sequence
  Synthetic construct
ggagtcttggtgtataccgag

SEQ ID NO: 4296 - DNA, 21 bp, Artificial Sequence
  Synthetic construct
gagtcttggtgtataccgaga

SEQ ID NO: 4297 - DNA, 21 bp, Artificial Sequence
  Synthetic construct
agtcttggtgtataccgagac

SEQ ID NO: 4298 - DNA, 21 bp, Artificial Sequence
  Synthetic construct
gtcttggtgtataccgagact

SEQ ID NO: 4299 - DNA, 21 bp, Artificial Sequence
  Synthetic construct
tcttggtgtataccgagactg

SEQ ID NO: 4300 - DNA, 21 bp, Artificial Sequence
  Synthetic construct
cttggtgtataccgagactgc

SEQ ID NO: 4301 - DNA, 21 bp, Artificial Sequence
  Synthetic construct
ttggtgtataccgagactgcc

SEQ ID NO: 4302 - DNA, 21 bp, Artificial Sequence
  Synthetic construct
tggtgtataccgagactgccg

SEQ ID NO: 4303 - DNA, 21 bp, Artificial Sequence
  Synthetic construct
ggtgtataccgagactgccgt

SEQ ID NO: 4304 - DNA, 21 bp, Artificial Sequence
  Synthetic construct
gtgtataccgagactgccgta

SEQ ID NO: 4305 - DNA, 21 bp, Artificial Sequence
  Synthetic construct
tgtataccgagactgccgtag

SEQ ID NO: 4306 - DNA, 21 bp, Artificial Sequence
  Synthetic construct
gtataccgagactgccgtagg

SEQ ID NO: 4307 - DNA, 21 bp, Artificial Sequence
  Synthetic construct
tataccgagactgccgtaggc

SEQ ID NO: 4308 - DNA, 21 bp, Artificial Sequence
  Synthetic construct
ataccgagactgccgtaggcg

SEQ ID NO: 4309 - DNA, 21 bp, Artificial Sequence
  Synthetic construct
taccgagactgccgtaggcgg

SEQ ID NO: 4310 - DNA, 21 bp, Artificial Sequence
  Synthetic construct
accgagactgccgtaggcggg

SEQ ID NO: 4311 - DNA, 21 bp, Artificial Sequence
  Synthetic construct
ccgagactgccgtaggcgggc

SEQ ID NO: 4312 - DNA, 21 bp, Artificial Sequence
  Synthetic construct
cgagactgccgtaggcgggct

SEQ ID NO: 4313 - DNA, 21 bp, Artificial Sequence
  Synthetic construct
gagactgccgtaggcgggctg

SEQ ID NO: 4314 - DNA, 21 bp, Artificial Sequence
  Synthetic construct
agactgccgtaggcgggctga

SEQ ID NO: 4315 - DNA, 21 bp, Artificial Sequence
  Synthetic construct
gactgccgtaggcgggctgac

SEQ ID NO: 4316 - DNA, 21 bp, Artificial Sequence
  Synthetic construct
actgccgtaggcgggctgact

SEQ ID NO: 4317 - DNA, 21 bp, Artificial Sequence
  Synthetic construct
ctgccgtaggcgggctgacta

SEQ ID NO: 4318 - DNA, 21 bp, Artificial Sequence
  Synthetic construct
tgccgtaggcgggctgactac

SEQ ID NO: 4319 - DNA, 21 bp, Artificial Sequence
  Synthetic construct
gccgtaggcgggctgactacg

SEQ ID NO: 4320 - DNA, 21 bp, Artificial Sequence
  Synthetic construct
ccgtaggcgggctgactacgt

SEQ ID NO: 4321 - DNA, 21 bp, Artificial Sequence
  Synthetic construct
cgtaggcgggctgactacgta

SEQ ID NO: 4322 - DNA, 21 bp, Artificial Sequence
  Synthetic construct
gtaggcgggctgactacgtag

SEQ ID NO: 4323 - DNA, 21 bp, Artificial Sequence
  Synthetic construct
taggcgggctgactacgtagt

SEQ ID NO: 4324 - DNA, 21 bp, Artificial Sequence
  Synthetic construct
aggcgggctgactacgtagta

SEQ ID NO: 4325 - DNA, 21 bp, Artificial Sequence
  Synthetic construct
ggcgggctgactacgtagtag

SEQ ID NO: 4326 - DNA, 21 bp, Artificial Sequence
  Synthetic construct
gcgggctgactacgtagtagt

SEQ ID NO: 4327 - DNA, 21 bp, Artificial Sequence
  Synthetic construct
cgggctgactacgtagtagtc

SEQ ID NO: 4328 - DNA, 21 bp, Artificial Sequence
  Synthetic construct
gggctgactacgtagtagtcg

SEQ ID NO: 4329 - DNA, 21 bp, Artificial Sequence
  Synthetic construct
ggctgactacgtagtagtcgg

SEQ ID NO: 4330 - DNA, 21 bp, Artificial Sequence
  Synthetic construct
gctgactacgtagtagtcggc

SEQ ID NO: 4331 - DNA, 21 bp, Artificial Sequence
  Synthetic construct
ctgactacgtagtagtcggca

SEQ ID NO: 4332 - DNA, 21 bp, Artificial Sequence
  Synthetic construct
tgactacgtagtagtcggcag

SEQ ID NO: 4333 - DNA, 21 bp, Artificial Sequence
  Synthetic construct
gactacgtagtagtcggcagc

SEQ ID NO: 4334 - DNA, 21 bp, Artificial Sequence
  Synthetic construct
actacgtagtagtcggcagcg

SEQ ID NO: 4335 - DNA, 21 bp, Artificial Sequence
  Synthetic construct
ctacgtagtagtcggcagcga

SEQ ID NO: 4336 - DNA, 21 bp, Artificial Sequence
  Synthetic construct
tacgtagtagtcggcagcgag

SEQ ID NO: 4337 - DNA, 21 bp, Artificial Sequence
  Synthetic construct
acgtagtagtcggcagcgagg

SEQ ID NO: 4338 - DNA, 21 bp, Artificial Sequence
  Synthetic construct
cgtagtagtcggcagcgaggt

SEQ ID NO: 4339 - DNA, 21 bp, Artificial Sequence
  Synthetic construct
gtagtagtcggcagcgaggtc

SEQ ID NO: 4340 - DNA, 21 bp, Artificial Sequence
  Synthetic construct
tagtagtcggcagcgaggtcc

SEQ ID NO: 4341 - DNA, 21 bp, Artificial Sequence
  Synthetic construct
agtagtcggcagcgaggtccg

SEQ ID NO: 4342 - DNA, 21 bp, Artificial Sequence
  Synthetic construct
gtagtcggcagcgaggtccgt

SEQ ID NO: 4343 - DNA, 21 bp, Artificial Sequence
  Synthetic construct
tagtcggcagcgaggtccgtc

SEQ ID NO: 4344 - DNA, 21 bp, Artificial Sequence
  Synthetic construct
agtcggcagcgaggtccgtcc

SEQ ID NO: 4345 - DNA, 21 bp, Artificial Sequence
  Synthetic construct
gtcggcagcgaggtccgtccc

SEQ ID NO: 4346 - DNA, 21 bp, Artificial Sequence
  Synthetic construct
tcggcagcgaggtccgtccca

SEQ ID NO: 4347 - DNA, 21 bp, Artificial Sequence
  Synthetic construct
cggcagcgaggtccgtcccac

SEQ ID NO: 4348 - DNA, 21 bp, Artificial Sequence
  Synthetic construct
ggcagcgaggtccgtcccacc

SEQ ID NO: 4349 - DNA, 21 bp, Artificial Sequence
  Synthetic construct
gcagcgaggtccgtcccaccg

SEQ ID NO: 4350 - DNA, 21 bp, Artificial Sequence
  Synthetic construct
cagcgaggtccgtcccaccga

SEQ ID NO: 4351 - DNA, 21 bp, Artificial Sequence
  Synthetic construct
agcgaggtccgtcccaccgaa

SEQ ID NO: 4352 - DNA, 21 bp, Artificial Sequence
  Synthetic construct
gcgaggtccgtcccaccgaag

SEQ ID NO: 4353 - DNA, 21 bp, Artificial Sequence
  Synthetic construct
cgaggtccgtcccaccgaaga

SEQ ID NO: 4354 - DNA, 21 bp, Artificial Sequence
  Synthetic construct
gaggtccgtcccaccgaagaa

SEQ ID NO: 4355 - DNA, 21 bp, Artificial Sequence
  Synthetic construct
aggtccgtcccaccgaagaac

SEQ ID NO: 4356 - DNA, 21 bp, Artificial Sequence
  Synthetic construct
ggtccgtcccaccgaagaaca

SEQ ID NO: 4357 - DNA, 21 bp, Artificial Sequence
  Synthetic construct
gtccgtcccaccgaagaacat

SEQ ID NO: 4358 - DNA, 21 bp, Artificial Sequence
  Synthetic construct
tccgtcccaccgaagaacatc

SEQ ID NO: 4359 - DNA, 21 bp, Artificial Sequence
  Synthetic construct
ccgtcccaccgaagaacatcg

SEQ ID NO: 4360 - DNA, 21 bp, Artificial Sequence
  Synthetic construct
cgtcccaccgaagaacatcga

SEQ ID NO: 4361 - DNA, 21 bp, Artificial Sequence
  Synthetic construct
gtcccaccgaagaacatcgaa

SEQ ID NO: 4362 - DNA, 21 bp, Artificial Sequence
  Synthetic construct
tcccaccgaagaacatcgaag

SEQ ID NO: 4363 - DNA, 21 bp, Artificial Sequence
  Synthetic construct
cccaccgaagaacatcgaagg

SEQ ID NO: 4364 - DNA, 21 bp, Artificial Sequence
  Synthetic construct
ccaccgaagaacatcgaaggc

SEQ ID NO: 4365 - DNA, 21 bp, Artificial Sequence
  Synthetic construct
caccgaagaacatcgaaggca

SEQ ID NO: 4366 - DNA, 21 bp, Artificial Sequence
  Synthetic construct
accgaagaacatcgaaggcac

SEQ ID NO: 4367 - DNA, 21 bp, Artificial Sequence
  Synthetic construct
ccgaagaacatcgaaggcacc

SEQ ID NO: 4368 - DNA, 21 bp, Artificial Sequence
  Synthetic construct
cgaagaacatcgaaggcacct

SEQ ID NO: 4369 - DNA, 21 bp, Artificial Sequence
  Synthetic construct
gaagaacatcgaaggcacctg

SEQ ID NO: 4370 - DNA, 21 bp, Artificial Sequence
  Synthetic construct
aagaacatcgaaggcacctgg

SEQ ID NO: 4371 - DNA, 21 bp, Artificial Sequence
  Synthetic construct
agaacatcgaaggcacctggg

SEQ ID NO: 4372 - DNA, 21 bp, Artificial Sequence
  Synthetic construct
gaacatcgaaggcacctggga

SEQ ID NO: 4373 - DNA, 21 bp, Artificial Sequence
  Synthetic construct
aacatcgaaggcacctgggag

SEQ ID NO: 4374 - DNA, 21 bp, Artificial Sequence
  Synthetic construct
acatcgaaggcacctgggagg

SEQ ID NO: 4375 - DNA, 21 bp, Artificial Sequence
  Synthetic construct
catcgaaggcacctgggagga

SEQ ID NO: 4376 - DNA, 21 bp, Artificial Sequence
  Synthetic construct
atcgaaggcacctgggaggag

SEQ ID NO: 4377 - DNA, 21 bp, Artificial Sequence
  Synthetic construct
tcgaaggcacctgggaggaga

SEQ ID NO: 4378 - DNA, 21 bp, Artificial Sequence
  Synthetic construct
cgaaggcacctgggaggagag

SEQ ID NO: 4379 - DNA, 21 bp, Artificial Sequence
  Synthetic construct
gaaggcacctgggaggagagc

SEQ ID NO: 4380 - DNA, 21 bp, Artificial Sequence
  Synthetic construct
aaggcacctgggaggagagcc

SEQ ID NO: 4381 - DNA, 21 bp, Artificial Sequence
  Synthetic construct
aggcacctgggaggagagccg

SEQ ID NO: 4382 - DNA, 21 bp, Artificial Sequence
  Synthetic construct
ggcacctgggaggagagccgt

SEQ ID NO: 4383 - DNA, 21 bp, Artificial Sequence
  Synthetic construct
gcacctgggaggagagccgta

SEQ ID NO: 4384 - DNA, 21 bp, Artificial Sequence
  Synthetic construct
cacctgggaggagagccgtac

SEQ ID NO: 4385 - DNA, 21 bp, Artificial Sequence
  Synthetic construct
acctgggaggagagccgtacc

SEQ ID NO: 4386 - DNA, 21 bp, Artificial Sequence
  Synthetic construct
cctgggaggagagccgtaccc

SEQ ID NO: 4387 - DNA, 21 bp, Artificial Sequence
  Synthetic construct
ctgggaggagagccgtaccca

SEQ ID NO: 4388 - DNA, 21 bp, Artificial Sequence
  Synthetic construct
tgggaggagagccgtacccac

SEQ ID NO: 4389 - DNA, 21 bp, Artificial Sequence
  Synthetic construct
gggaggagagccgtacccaca

SEQ ID NO: 4390 - DNA, 21 bp, Artificial Sequence
  Synthetic construct
ggaggagagccgtacccacac

SEQ ID NO: 4391 - DNA, 21 bp, Artificial Sequence
  Synthetic construct
gaggagagccgtacccacacc

SEQ ID NO: 4392 - DNA, 21 bp, Artificial Sequence
  Synthetic construct
aggagagccgtacccacacct

SEQ ID NO: 4393 - DNA, 21 bp, Artificial Sequence
  Synthetic construct
ggagagccgtacccacacctt

SEQ ID NO: 4394 - DNA, 21 bp, Artificial Sequence
  Synthetic construct
gagagccgtacccacacctta

SEQ ID NO: 4395 - DNA, 21 bp, Artificial Sequence
  Synthetic construct
agagccgtacccacaccttat

SEQ ID NO: 4396 - DNA, 21 bp, Artificial Sequence
  Synthetic construct
gagccgtacccacaccttata

SEQ ID NO: 4397 - DNA, 21 bp, Artificial Sequence
  Synthetic construct
agccgtacccacaccttatag

SEQ ID NO: 4398 - DNA, 21 bp, Artificial Sequence
  Synthetic construct
gccgtacccacaccttataga

SEQ ID NO: 4399 - DNA, 21 bp, Artificial Sequence
  Synthetic construct
ccgtacccacaccttatagag

SEQ ID NO: 4400 - DNA, 21 bp, Artificial Sequence
  Synthetic construct
cgtacccacaccttatagagg

SEQ ID NO: 4401 - DNA, 21 bp, Artificial Sequence
  Synthetic construct
gtacccacaccttatagaggc

SEQ ID NO: 4402 - DNA, 21 bp, Artificial Sequence
  Synthetic construct
tacccacaccttatagaggcg

SEQ ID NO: 4403 - DNA, 21 bp, Artificial Sequence
  Synthetic construct
acccacaccttatagaggcgt

SEQ ID NO: 4404 - DNA, 21 bp, Artificial Sequence
  Synthetic construct
cccacaccttatagaggcgtg

SEQ ID NO: 4405 - DNA, 21 bp, Artificial Sequence
  Synthetic construct
ccacaccttatagaggcgtgg

SEQ ID NO: 4406 - DNA, 21 bp, Artificial Sequence
  Synthetic construct
cacaccttatagaggcgtgga

SEQ ID NO: 4407 - DNA, 21 bp, Artificial Sequence
  Synthetic construct
acaccttatagaggcgtggat

SEQ ID NO: 4408 - DNA, 21 bp, Artificial Sequence
  Synthetic construct
caccttatagaggcgtggatc

SEQ ID NO: 4409 - DNA, 21 bp, Artificial Sequence
  Synthetic construct
accttatagaggcgtggatct

SEQ ID NO: 4410 - DNA, 21 bp, Artificial Sequence
  Synthetic construct
ccttatagaggcgtggatctg

SEQ ID NO: 4411 - DNA, 21 bp, Artificial Sequence
  Synthetic construct
cttatagaggcgtggatctga

SEQ ID NO: 4412 - DNA, 21 bp, Artificial Sequence
  Synthetic construct
ttatagaggcgtggatctgac

SEQ ID NO: 4413 - DNA, 21 bp, Artificial Sequence
  Synthetic construct
tatagaggcgtggatctgaca

SEQ ID NO: 4414 - DNA, 21 bp, Artificial Sequence
  Synthetic construct
atagaggcgtggatctgacat

SEQ ID NO: 4415 - DNA, 21 bp, Artificial Sequence
  Synthetic construct
tagaggcgtggatctgacata

SEQ ID NO: 4416 - DNA, 21 bp, Artificial Sequence
  Synthetic construct
agaggcgtggatctgacatac

SEQ ID NO: 4417 - DNA, 21 bp, Artificial Sequence
  Synthetic construct
gaggcgtggatctgacatacc

SEQ ID NO: 4418 - DNA, 21 bp, Artificial Sequence
  Synthetic construct
aggcgtggatctgacatacct

SEQ ID NO: 4419 - DNA, 21 bp, Artificial Sequence
  Synthetic construct
ggcgtggatctgacatacctc

SEQ ID NO: 4420 - DNA, 21 bp, Artificial Sequence
  Synthetic construct
gcgtggatctgacatacctcc

SEQ ID NO: 4421 - DNA, 21 bp, Artificial Sequence
  Synthetic construct
cgtggatctgacatacctccg

SEQ ID NO: 4422 - DNA, 21 bp, Artificial Sequence
  Synthetic construct
gtggatctgacatacctccga

SEQ ID NO: 4423 - DNA, 21 bp, Artificial Sequence
  Synthetic construct
tggatctgacatacctccgac

SEQ ID NO: 4424 - DNA, 21 bp, Artificial Sequence
  Synthetic construct
ggatctgacatacctccgaca

SEQ ID NO: 4425 - DNA, 21 bp, Artificial Sequence
  Synthetic construct
gatctgacatacctccgacaa

SEQ ID NO: 4426 - DNA, 21 bp, Artificial Sequence
  Synthetic construct
atctgacatacctccgacaac

SEQ ID NO: 4427 - DNA, 21 bp, Artificial Sequence
  Synthetic construct
tctgacatacctccgacaact

SEQ ID NO: 4428 - DNA, 21 bp, Artificial Sequence
  Synthetic construct
ctgacatacctccgacaactc

SEQ ID NO: 4429 - DNA, 21 bp, Artificial Sequence
  Synthetic construct
tgacatacctccgacaactcc

SEQ ID NO: 4430 - DNA, 21 bp, Artificial Sequence
  Synthetic construct
gacatacctccgacaactccc

SEQ ID NO: 4431 - DNA, 21 bp, Artificial Sequence
  Synthetic construct
acatacctccgacaactcccc

SEQ ID NO: 4432 - DNA, 21 bp, Artificial Sequence
  Synthetic construct
catacctccgacaactcccca

SEQ ID NO: 4433 - DNA, 21 bp, Artificial Sequence
  Synthetic construct
atacctccgacaactccccaa

SEQ ID NO: 4434 - DNA, 21 bp, Artificial Sequence
  Synthetic construct
tacctccgacaactccccaac

SEQ ID NO: 4435 - DNA, 21 bp, Artificial Sequence
  Synthetic construct
acctccgacaactccccaacc

SEQ ID NO: 4436 - DNA, 21 bp, Artificial Sequence
  Synthetic construct
cctccgacaactccccaaccc

SEQ ID NO: 4437 - DNA, 21 bp, Artificial Sequence
  Synthetic construct
ctccgacaactccccaacccc

SEQ ID NO: 4438 - DNA, 21 bp, Artificial Sequence
  Synthetic construct
tccgacaactccccaaccccg

SEQ ID NO: 4439 - DNA, 21 bp, Artificial Sequence
  Synthetic construct
ccgacaactccccaaccccgt

SEQ ID NO: 4440 - DNA, 21 bp, Artificial Sequence
  Synthetic construct
cgacaactccccaaccccgta

SEQ ID NO: 4441 - DNA, 21 bp, Artificial Sequence
  Synthetic construct
gacaactccccaaccccgtag

SEQ ID NO: 4442 - DNA, 21 bp, Artificial Sequence
  Synthetic construct
acaactccccaaccccgtagc

SEQ ID NO: 4443 - DNA, 21 bp, Artificial Sequence
  Synthetic construct
caactccccaaccccgtagcc

SEQ ID NO: 4444 - DNA, 21 bp, Artificial Sequence
  Synthetic construct
aactccccaaccccgtagccg

SEQ ID NO: 4445 - DNA, 21 bp, Artificial Sequence
  Synthetic construct
actccccaaccccgtagccga

SEQ ID NO: 4446 - DNA, 21 bp, Artificial Sequence
  Synthetic construct
ctccccaaccccgtagccgat

SEQ ID NO: 4447 - DNA, 21 bp, Artificial Sequence
  Synthetic construct
tccccaaccccgtagccgatt

SEQ ID NO: 4448 - DNA, 21 bp, Artificial Sequence
  Synthetic construct
ccccaaccccgtagccgattt

SEQ ID NO: 4449 - DNA, 21 bp, Artificial Sequence
  Synthetic construct
cccaaccccgtagccgattta

SEQ ID NO: 4450 - DNA, 21 bp, Artificial Sequence
  Synthetic construct
ccaaccccgtagccgatttaa

SEQ ID NO: 4451 - DNA, 21 bp, Artificial Sequence
  Synthetic construct
caaccccgtagccgatttaat

SEQ ID NO: 4452 - DNA, 21 bp, Artificial Sequence
  Synthetic construct
aaccccgtagccgatttaata

SEQ ID NO: 4453 - DNA, 21 bp, Artificial Sequence
  Synthetic construct
accccgtagccgatttaatat

SEQ ID NO: 4454 - DNA, 21 bp, Artificial Sequence
  Synthetic construct
ccccgtagccgatttaatatc

SEQ ID NO: 4455 - DNA, 21 bp, Artificial Sequence
  Synthetic construct
cccgtagccgatttaatatca

SEQ ID NO: 4456 - DNA, 21 bp, Artificial Sequence
  Synthetic construct
ccgtagccgatttaatatcag

SEQ ID NO: 4457 - DNA, 21 bp, Artificial Sequence
  Synthetic construct
cgtagccgatttaatatcagc

SEQ ID NO: 4458 - DNA, 21 bp, Artificial Sequence
  Synthetic construct
gtagccgatttaatatcagca

SEQ ID NO: 4459 - DNA, 21 bp, Artificial Sequence
  Synthetic construct
tagccgatttaatatcagcat

SEQ ID NO: 4460 - DNA, 21 bp, Artificial Sequence
  Synthetic construct
agccgatttaatatcagcatc

SEQ ID NO: 4461 - DNA, 21 bp, Artificial Sequence
  Synthetic construct
gccgatttaatatcagcatca

SEQ ID NO: 4462 - DNA, 21 bp, Artificial Sequence
  Synthetic construct
ccgatttaatatcagcatcag

SEQ ID NO: 4463 - DNA, 21 bp, Artificial Sequence
  Synthetic construct
cgatttaatatcagcatcagg

SEQ ID NO: 4464 - DNA, 21 bp, Artificial Sequence
  Synthetic construct
gatttaatatcagcatcaggg

SEQ ID NO: 4465 - DNA, 21 bp, Artificial Sequence
  Synthetic construct
atttaatatcagcatcagggc

SEQ ID NO: 4466 - DNA, 21 bp, Artificial Sequence
  Synthetic construct
tttaatatcagcatcagggcg

SEQ ID NO: 4467 - DNA, 21 bp, Artificial Sequence
  Synthetic construct
ttaatatcagcatcagggcga

SEQ ID NO: 4468 - DNA, 21 bp, Artificial Sequence
  Synthetic construct
taatatcagcatcagggcgaa

SEQ ID NO: 4469 - DNA, 21 bp, Artificial Sequence
  Synthetic construct
aatatcagcatcagggcgaag

SEQ ID NO: 4470 - DNA, 21 bp, Artificial Sequence
  Synthetic construct
atatcagcatcagggcgaaga

SEQ ID NO: 4471 - DNA, 21 bp, Artificial Sequence
  Synthetic construct
tatcagcatcagggcgaagag

SEQ ID NO: 4472 - DNA, 21 bp, Artificial Sequence
  Synthetic construct
atcagcatcagggcgaagaga

SEQ ID NO: 4473 - DNA, 21 bp, Artificial Sequence
  Synthetic construct
tcagcatcagggcgaagagat

SEQ ID NO: 4474 - DNA, 21 bp, Artificial Sequence
  Synthetic construct
cagcatcagggcgaagagatt

SEQ ID NO: 4475 - DNA, 21 bp, Artificial Sequence
  Synthetic construct
agcatcagggcgaagagattg

SEQ ID NO: 4476 - DNA, 21 bp, Artificial Sequence
  Synthetic construct
gcatcagggcgaagagattgt

SEQ ID NO: 4477 - DNA, 21 bp, Artificial Sequence
  Synthetic construct
catcagggcgaagagattgtc

SEQ ID NO: 4478 - DNA, 21 bp, Artificial Sequence
  Synthetic construct
atcagggcgaagagattgtca

SEQ ID NO: 4479 - DNA, 21 bp, Artificial Sequence
  Synthetic construct
tcagggcgaagagattgtcaa

SEQ ID NO: 4480 - DNA, 21 bp, Artificial Sequence
  Synthetic construct
cagggcgaagagattgtcaac

SEQ ID NO: 4481 - DNA, 21 bp, Artificial Sequence
  Synthetic construct
agggcgaagagattgtcaaca

SEQ ID NO: 4482 - DNA, 21 bp, Artificial Sequence
  Synthetic construct
gggcgaagagattgtcaacag

SEQ ID NO: 4483 - DNA, 21 bp, Artificial Sequence
  Synthetic construct
ggcgaagagattgtcaacagg

SEQ ID NO: 4484 - DNA, 21 bp, Artificial Sequence
  Synthetic construct
gcgaagagattgtcaacaggt

SEQ ID NO: 4485 - DNA, 21 bp, Artificial Sequence
  Synthetic construct
cgaagagattgtcaacaggtt

SEQ ID NO: 4486 - DNA, 21 bp, Artificial Sequence
  Synthetic construct
gaagagattgtcaacaggttt

SEQ ID NO: 4487 - DNA, 21 bp, Artificial Sequence
  Synthetic construct
aagagattgtcaacaggtttc

SEQ ID NO: 4488 - DNA, 21 bp, Artificial Sequence
  Synthetic construct
agagattgtcaacaggtttct

SEQ ID NO: 4489 - DNA, 21 bp, Artificial Sequence
  Synthetic construct
gagattgtcaacaggtttctt

SEQ ID NO: 4490 - DNA, 21 bp, Artificial Sequence
  Synthetic construct
agattgtcaacaggtttcttg

SEQ ID NO: 4491 - DNA, 21 bp, Artificial Sequence
  Synthetic construct
gattgtcaacaggtttcttga

SEQ ID NO: 4492 - DNA, 21 bp, Artificial Sequence
  Synthetic construct
attgtcaacaggtttcttgat

SEQ ID NO: 4493 - DNA, 21 bp, Artificial Sequence
  Synthetic construct
ttgtcaacaggtttcttgatg

SEQ ID NO: 4494 - DNA, 21 bp, Artificial Sequence
  Synthetic construct
tgtcaacaggtttcttgatgt

SEQ ID NO: 4495 - DNA, 21 bp, Artificial Sequence
  Synthetic construct
gtcaacaggtttcttgatgta

SEQ ID NO: 4496 - DNA, 21 bp, Artificial Sequence
  Synthetic construct
tcaacaggtttcttgatgtaa

SEQ ID NO: 4497 - DNA, 21 bp, Artificial Sequence
  Synthetic construct
caacaggtttcttgatgtaaa

SEQ ID NO: 4498 - DNA, 21 bp, Artificial Sequence
  Synthetic construct
aacaggtttcttgatgtaaaa

SEQ ID NO: 4499 - DNA, 21 bp, Artificial Sequence
  Synthetic construct
acaggtttcttgatgtaaaac

SEQ ID NO: 4500 - DNA, 21 bp, Artificial Sequence
  Synthetic construct
caggtttcttgatgtaaaacg

SEQ ID NO: 4501 - DNA, 21 bp, Artificial Sequence
  Synthetic construct
aggtttcttgatgtaaaacgg

SEQ ID NO: 4502 - DNA, 21 bp, Artificial Sequence
  Synthetic construct
ggtttcttgatgtaaaacggt

SEQ ID NO: 4503 - DNA, 21 bp, Artificial Sequence
  Synthetic construct
gtttcttgatgtaaaacggtt

SEQ ID NO: 4504 - DNA, 21 bp, Artificial Sequence
  Synthetic construct
tttcttgatgtaaaacggttt

SEQ ID NO: 4505 - DNA, 21 bp, Artificial Sequence
  Synthetic construct
ttcttgatgtaaaacggtttg

SEQ ID NO: 4506 - DNA, 21 bp, Artificial Sequence
  Synthetic construct
tcttgatgtaaaacggtttga

SEQ ID NO: 4507 - DNA, 21 bp, Artificial Sequence
  Synthetic construct
cttgatgtaaaacggtttgac

SEQ ID NO: 4508 - DNA, 21 bp, Artificial Sequence
  Synthetic construct
ttgatgtaaaacggtttgaca

SEQ ID NO: 4509 - DNA, 21 bp, Artificial Sequence
  Synthetic construct
tgatgtaaaacggtttgacat

SEQ ID NO: 4510 - DNA, 21 bp, Artificial Sequence
  Synthetic construct
gatgtaaaacggtttgacatc

SEQ ID NO: 4511 - DNA, 21 bp, Artificial Sequence
  Synthetic construct
atgtaaaacggtttgacatcg

SEQ ID NO: 4512 - DNA, 21 bp, Artificial Sequence
  Synthetic construct
tgtaaaacggtttgacatcga

SEQ ID NO: 4513 - DNA, 21 bp, Artificial Sequence
  Synthetic construct
gtaaaacggtttgacatcgac

SEQ ID NO: 4514 - DNA, 21 bp, Artificial Sequence
  Synthetic construct
taaaacggtttgacatcgaca

SEQ ID NO: 4515 - DNA, 21 bp, Artificial Sequence
  Synthetic construct
aaaacggtttgacatcgacac

SEQ ID NO: 4516 - DNA, 21 bp, Artificial Sequence
  Synthetic construct
aaacggtttgacatcgacacc

SEQ ID NO: 4517 - DNA, 21 bp, Artificial Sequence
  Synthetic construct
aacggtttgacatcgacacca

SEQ ID NO: 4518 - DNA, 21 bp, Artificial Sequence
  Synthetic construct
acggtttgacatcgacaccac

SEQ ID NO: 4519 - DNA, 21 bp, Artificial Sequence
  Synthetic construct
cggtttgacatcgacaccacg

SEQ ID NO: 4520 - DNA, 21 bp, Artificial Sequence
  Synthetic construct
ggtttgacatcgacaccacgg

SEQ ID NO: 4521 - DNA, 21 bp, Artificial Sequence
  Synthetic construct
gtttgacatcgacaccacggt

SEQ ID NO: 4522 - DNA, 21 bp, Artificial Sequence
  Synthetic construct
tttgacatcgacaccacggta

SEQ ID NO: 4523 - DNA, 21 bp, Artificial Sequence
  Synthetic construct
ttgacatcgacaccacggtaa

SEQ ID NO: 4524 - DNA, 21 bp, Artificial Sequence
  Synthetic construct
tgacatcgacaccacggtaaa

SEQ ID NO: 4525 - DNA, 21 bp, Artificial Sequence
  Synthetic construct
gacatcgacaccacggtaaaa

SEQ ID NO: 4526 - DNA, 21 bp, Artificial Sequence
  Synthetic construct
acatcgacaccacggtaaaag

SEQ ID NO: 4527 - DNA, 21 bp, Artificial Sequence
  Synthetic construct
catcgacaccacggtaaaagt

SEQ ID NO: 4528 - DNA, 21 bp, Artificial Sequence
  Synthetic construct
atcgacaccacggtaaaagtg

SEQ ID NO: 4529 - DNA, 21 bp, Artificial Sequence
  Synthetic construct
tcgacaccacggtaaaagtgc

SEQ ID NO: 4530 - DNA, 21 bp, Artificial Sequence
  Synthetic construct
cgacaccacggtaaaagtgcg

SEQ ID NO: 4531 - DNA, 21 bp, Artificial Sequence
  Synthetic construct
gacaccacggtaaaagtgcgc

SEQ ID NO: 4532 - DNA, 21 bp, Artificial Sequence
  Synthetic construct
acaccacggtaaaagtgcgcg

SEQ ID NO: 4533 - DNA, 21 bp, Artificial Sequence
  Synthetic construct
caccacggtaaaagtgcgcgc

SEQ ID NO: 4534 - DNA, 21 bp, Artificial Sequence
  Synthetic construct
accacggtaaaagtgcgcgcc

SEQ ID NO: 4535 - DNA, 21 bp, Artificial Sequence
  Synthetic construct
ccacggtaaaagtgcgcgccg

SEQ ID NO: 4536 - DNA, 21 bp, Artificial Sequence
  Synthetic construct
cacggtaaaagtgcgcgccgc

SEQ ID NO: 4537 - DNA, 21 bp, Artificial Sequence
  Synthetic construct
acggtaaaagtgcgcgccgca

SEQ ID NO: 4538 - DNA, 21 bp, Artificial Sequence
  Synthetic construct
cggtaaaagtgcgcgccgcag

SEQ ID NO: 4539 - DNA, 21 bp, Artificial Sequence
  Synthetic construct
ggtaaaagtgcgcgccgcagc

SEQ ID NO: 4540 - DNA, 21 bp, Artificial Sequence
  Synthetic construct
gtaaaagtgcgcgccgcagct

SEQ ID NO: 4541 - DNA, 21 bp, Artificial Sequence
  Synthetic construct
taaaagtgcgcgccgcagctc

SEQ ID NO: 4542 - DNA, 21 bp, Artificial Sequence
  Synthetic construct
aaaagtgcgcgccgcagctct

SEQ ID NO: 4543 - DNA, 21 bp, Artificial Sequence
  Synthetic construct
aaagtgcgcgccgcagctctc

SEQ ID NO: 4544 - DNA, 21 bp, Artificial Sequence
  Synthetic construct
aagtgcgcgccgcagctctcg

SEQ ID NO: 4545 - DNA, 21 bp, Artificial Sequence
  Synthetic construct
agtgcgcgccgcagctctcgc

SEQ ID NO: 4546 - DNA, 21 bp, Artificial Sequence
  Synthetic construct
gtgcgcgccgcagctctcgcg

SEQ ID NO: 4547 - DNA, 21 bp, Artificial Sequence
  Synthetic construct
tgcgcgccgcagctctcgcga

SEQ ID NO: 4548 - DNA, 21 bp, Artificial Sequence
  Synthetic construct
gcgcgccgcagctctcgcgaa

SEQ ID NO: 4549 - DNA, 21 bp, Artificial Sequence
  Synthetic construct
cgcgccgcagctctcgcgaaa

SEQ ID NO: 4550 - DNA, 21 bp, Artificial Sequence
  Synthetic construct
gcgccgcagctctcgcgaaag

SEQ ID NO: 4551 - DNA, 21 bp, Artificial Sequence
  Synthetic construct
cgccgcagctctcgcgaaaga

SEQ ID NO: 4552 - DNA, 21 bp, Artificial Sequence
  Synthetic construct
gccgcagctctcgcgaaagag

SEQ ID NO: 4553 - DNA, 21 bp, Artificial Sequence
  Synthetic construct
ccgcagctctcgcgaaagagc

SEQ ID NO: 4554 - DNA, 21 bp, Artificial Sequence
  Synthetic construct
cgcagctctcgcgaaagagcc

SEQ ID NO: 4555 - DNA, 21 bp, Artificial Sequence
  Synthetic construct
gcagctctcgcgaaagagccc

SEQ ID NO: 4556 - DNA, 21 bp, Artificial Sequence
  Synthetic construct
cagctctcgcgaaagagcccg

SEQ ID NO: 4557 - DNA, 21 bp, Artificial Sequence
  Synthetic construct
agctctcgcgaaagagcccgg

SEQ ID NO: 4558 - DNA, 21 bp, Artificial Sequence
  Synthetic construct
gctctcgcgaaagagcccgga

SEQ ID NO: 4559 - DNA, 21 bp, Artificial Sequence
  Synthetic construct
ctctcgcgaaagagcccggac

SEQ ID NO: 4560 - DNA, 21 bp, Artificial Sequence
  Synthetic construct
tctcgcgaaagagcccggaca

SEQ ID NO: 4561 - DNA, 21 bp, Artificial Sequence
  Synthetic construct
ctcgcgaaagagcccggacac

SEQ ID NO: 4562 - DNA, 21 bp, Artificial Sequence
  Synthetic construct
tcgcgaaagagcccggacacg

SEQ ID NO: 4563 - DNA, 21 bp, Artificial Sequence
  Synthetic construct
cgcgaaagagcccggacacga

SEQ ID NO: 4564 - DNA, 21 bp, Artificial Sequence
  Synthetic construct
gcgaaagagcccggacacgaa

SEQ ID NO: 4565 - DNA, 21 bp, Artificial Sequence
  Synthetic construct
cgaaagagcccggacacgaac

SEQ ID NO: 4566 - DNA, 21 bp, Artificial Sequence
  Synthetic construct
gaaagagcccggacacgaacg

SEQ ID NO: 4567 - DNA, 21 bp, Artificial Sequence
  Synthetic construct
aaagagcccggacacgaacgt

SEQ ID NO: 4568 - DNA, 21 bp, Artificial Sequence
  Synthetic construct
aagagcccggacacgaacgtt

SEQ ID NO: 4569 - DNA, 21 bp, Artificial Sequence
  Synthetic construct
agagcccggacacgaacgttt

SEQ ID NO: 4570 - DNA, 21 bp, Artificial Sequence
  Synthetic construct
gagcccggacacgaacgtttt

SEQ ID NO: 4571 - DNA, 21 bp, Artificial Sequence
  Synthetic construct
agcccggacacgaacgtttta

SEQ ID NO: 4572 - DNA, 21 bp, Artificial Sequence
  Synthetic construct
gcccggacacgaacgttttac

SEQ ID NO: 4573 - DNA, 21 bp, Artificial Sequence
  Synthetic construct
cccggacacgaacgttttacg

SEQ ID NO: 4574 - DNA, 21 bp, Artificial Sequence
  Synthetic construct
ccggacacgaacgttttacga

SEQ ID NO: 4575 - DNA, 21 bp, Artificial Sequence
  Synthetic construct
cggacacgaacgttttacgaa

SEQ ID NO: 4576 - DNA, 21 bp, Artificial Sequence
  Synthetic construct
ggacacgaacgttttacgaag

SEQ ID NO: 4577 - DNA, 21 bp, Artificial Sequence
  Synthetic construct
gacacgaacgttttacgaaga

SEQ ID NO: 4578 - DNA, 21 bp, Artificial Sequence
  Synthetic construct
acacgaacgttttacgaagat

SEQ ID NO: 4579 - DNA, 21 bp, Artificial Sequence
  Synthetic construct
cacgaacgttttacgaagatt

SEQ ID NO: 4580 - DNA, 21 bp, Artificial Sequence
  Synthetic construct
acgaacgttttacgaagattc

SEQ ID NO: 4581 - DNA, 21 bp, Artificial Sequence
  Synthetic construct
cgaacgttttacgaagattcg

SEQ ID NO: 4582 - DNA, 21 bp, Artificial Sequence
  Synthetic construct
gaacgttttacgaagattcgg

SEQ ID NO: 4583 - DNA, 21 bp, Artificial Sequence
  Synthetic construct
aacgttttacgaagattcggt

SEQ ID NO: 4584 - DNA, 21 bp, Artificial Sequence
  Synthetic construct
acgttttacgaagattcggtt

SEQ ID NO: 4585 - DNA, 21 bp, Artificial Sequence
  Synthetic construct
cgttttacgaagattcggttt

SEQ ID NO: 4586 - DNA, 21 bp, Artificial Sequence
  Synthetic construct
gttttacgaagattcggttta

SEQ ID NO: 4587 - DNA, 21 bp, Artificial Sequence
  Synthetic construct
ttttacgaagattcggtttaa

SEQ ID NO: 4588 - DNA, 21 bp, Artificial Sequence
  Synthetic construct
tttacgaagattcggtttaaa

SEQ ID NO: 4589 - DNA, 21 bp, Artificial Sequence
  Synthetic construct
ttacgaagattcggtttaaaa

SEQ ID NO: 4590 - DNA, 21 bp, Artificial Sequence
  Synthetic construct
tacgaagattcggtttaaaac

SEQ ID NO: 4591 - DNA, 21 bp, Artificial Sequence
  Synthetic construct
acgaagattcggtttaaaacc

SEQ ID NO: 4592 - DNA, 21 bp, Artificial Sequence
  Synthetic construct
cgaagattcggtttaaaaccg

SEQ ID NO: 4593 - DNA, 21 bp, Artificial Sequence
  Synthetic construct
gaagattcggtttaaaaccgt

SEQ ID NO: 4594 - DNA, 21 bp, Artificial Sequence
  Synthetic construct
aagattcggtttaaaaccgta

SEQ ID NO: 4595 - DNA, 21 bp, Artificial Sequence
  Synthetic construct
agattcggtttaaaaccgtag

SEQ ID NO: 4596 - DNA, 21 bp, Artificial Sequence
  Synthetic construct
gattcggtttaaaaccgtagt

SEQ ID NO: 4597 - DNA, 21 bp, Artificial Sequence
  Synthetic construct
attcggtttaaaaccgtagta

SEQ ID NO: 4598 - DNA, 21 bp, Artificial Sequence
  Synthetic construct
ttcggtttaaaaccgtagtag

SEQ ID NO: 4599 - DNA, 21 bp, Artificial Sequence
  Synthetic construct
tcggtttaaaaccgtagtagg

SEQ ID NO: 4600 - DNA, 21 bp, Artificial Sequence
  Synthetic construct
cggtttaaaaccgtagtaggc

SEQ ID NO: 4601 - DNA, 21 bp, Artificial Sequence
  Synthetic construct
ggtttaaaaccgtagtaggca

SEQ ID NO: 4602 - DNA, 21 bp, Artificial Sequence
  Synthetic construct
gtttaaaaccgtagtaggcaa

SEQ ID NO: 4603 - DNA, 21 bp, Artificial Sequence
  Synthetic construct
tttaaaaccgtagtaggcaag

SEQ ID NO: 4604 - DNA, 21 bp, Artificial Sequence
  Synthetic construct
ttaaaaccgtagtaggcaagt

SEQ ID NO: 4605 - DNA, 21 bp, Artificial Sequence
  Synthetic construct
taaaaccgtagtaggcaagtg

SEQ ID NO: 4606 - DNA, 21 bp, Artificial Sequence
  Synthetic construct
aaaaccgtagtaggcaagtgc

SEQ ID NO: 4607 - DNA, 21 bp, Artificial Sequence
  Synthetic construct
aaaccgtagtaggcaagtgcc

SEQ ID NO: 4608 - DNA, 21 bp, Artificial Sequence
  Synthetic construct
aaccgtagtaggcaagtgcct

SEQ ID NO: 4609 - DNA, 21 bp, Artificial Sequence
  Synthetic construct
accgtagtaggcaagtgcctc

SEQ ID NO: 4610 - DNA, 21 bp, Artificial Sequence
  Synthetic construct
ccgtagtaggcaagtgcctct

SEQ ID NO: 4611 - DNA, 21 bp, Artificial Sequence
  Synthetic construct
cgtagtaggcaagtgcctcta

SEQ ID NO: 4612 - DNA, 21 bp, Artificial Sequence
  Synthetic construct
gtagtaggcaagtgcctctag

SEQ ID NO: 4613 - DNA, 21 bp, Artificial Sequence
  Synthetic construct
tagtaggcaagtgcctctagc

SEQ ID NO: 4614 - DNA, 21 bp, Artificial Sequence
  Synthetic construct
agtaggcaagtgcctctagca

SEQ ID NO: 4615 - DNA, 21 bp, Artificial Sequence
  Synthetic construct
gtaggcaagtgcctctagcac

SEQ ID NO: 4616 - DNA, 21 bp, Artificial Sequence
  Synthetic construct
taggcaagtgcctctagcaca

SEQ ID NO: 4617 - DNA, 21 bp, Artificial Sequence
  Synthetic construct
aggcaagtgcctctagcacac

SEQ ID NO: 4618 - DNA, 21 bp, Artificial Sequence
  Synthetic construct
ggcaagtgcctctagcacacg

SEQ ID NO: 4619 - DNA, 21 bp, Artificial Sequence
  Synthetic construct
gcaagtgcctctagcacacgg

SEQ ID NO: 4620 - DNA, 21 bp, Artificial Sequence
  Synthetic construct
caagtgcctctagcacacggg

SEQ ID NO: 4621 - DNA, 21 bp, Artificial Sequence
  Synthetic construct
aagtgcctctagcacacgggg

SEQ ID NO: 4622 - DNA, 21 bp, Artificial Sequence
  Synthetic construct
agtgcctctagcacacggggt

SEQ ID NO: 4623 - DNA, 21 bp, Artificial Sequence
  Synthetic construct
gtgcctctagcacacggggtg

SEQ ID NO: 4624 - DNA, 21 bp, Artificial Sequence
  Synthetic construct
tgcctctagcacacggggtgc

SEQ ID NO: 4625 - DNA, 21 bp, Artificial Sequence
  Synthetic construct
gcctctagcacacggggtgca

SEQ ID NO: 4626 - DNA, 21 bp, Artificial Sequence
  Synthetic construct
cctctagcacacggggtgcaa

SEQ ID NO: 4627 - DNA, 21 bp, Artificial Sequence
  Synthetic construct
ctctagcacacggggtgcaat

SEQ ID NO: 4628 - DNA, 21 bp, Artificial Sequence
  Synthetic construct
tctagcacacggggtgcaatc

SEQ ID NO: 4629 - DNA, 21 bp, Artificial Sequence
  Synthetic construct
ctagcacacggggtgcaatct

SEQ ID NO: 4630 - DNA, 21 bp, Artificial Sequence
  Synthetic construct
tagcacacggggtgcaatctc

SEQ ID NO: 4631 - DNA, 21 bp, Artificial Sequence
  Synthetic construct
agcacacggggtgcaatctca

SEQ ID NO: 4632 - DNA, 21 bp, Artificial Sequence
  Synthetic construct
gcacacggggtgcaatctcac

SEQ ID NO: 4633 - DNA, 21 bp, Artificial Sequence
  Synthetic construct
cacacggggtgcaatctcact

SEQ ID NO: 4634 - DNA, 21 bp, Artificial Sequence
  Synthetic construct
acacggggtgcaatctcactg

SEQ ID NO: 4635 - DNA, 21 bp, Artificial Sequence
  Synthetic construct
cacggggtgcaatctcactgg

SEQ ID NO: 4636 - DNA, 21 bp, Artificial Sequence
  Synthetic construct
acggggtgcaatctcactggg

SEQ ID NO: 4637 - DNA, 21 bp, Artificial Sequence
  Synthetic construct
cggggtgcaatctcactggga

SEQ ID NO: 4638 - DNA, 21 bp, Artificial Sequence
  Synthetic construct
ggggtgcaatctcactgggac

SEQ ID NO: 4639 - DNA, 21 bp, Artificial Sequence
  Synthetic construct
gggtgcaatctcactgggaca

SEQ ID NO: 4640 - DNA, 21 bp, Artificial Sequence
  Synthetic construct
ggtgcaatctcactgggacat

SEQ ID NO: 4641 - DNA, 21 bp, Artificial Sequence
  Synthetic construct
gtgcaatctcactgggacata

SEQ ID NO: 4642 - DNA, 21 bp, Artificial Sequence
  Synthetic construct
tgcaatctcactgggacatat

SEQ ID NO: 4643 - DNA, 21 bp, Artificial Sequence
  Synthetic construct
gcaatctcactgggacatata

SEQ ID NO: 4644 - DNA, 21 bp, Artificial Sequence
  Synthetic construct
caatctcactgggacatataa

SEQ ID NO: 4645 - DNA, 21 bp, Artificial Sequence
  Synthetic construct
aatctcactgggacatataat

SEQ ID NO: 4646 - DNA, 21 bp, Artificial Sequence
  Synthetic construct
atctcactgggacatataata

SEQ ID NO: 4647 - DNA, 21 bp, Artificial Sequence
  Synthetic construct
tctcactgggacatataatat

SEQ ID NO: 4648 - DNA, 21 bp, Artificial Sequence
  Synthetic construct
ctcactgggacatataatatc

SEQ ID NO: 4649 - DNA, 21 bp, Artificial Sequence
  Synthetic construct
tcactgggacatataatatcg

SEQ ID NO: 4650 - DNA, 21 bp, Artificial Sequence
  Synthetic construct
cactgggacatataatatcgt

SEQ ID NO: 4651 - DNA, 21 bp, Artificial Sequence
  Synthetic construct
actgggacatataatatcgtc

SEQ ID NO: 4652 - DNA, 21 bp, Artificial Sequence
  Synthetic construct
ctgggacatataatatcgtcc

SEQ ID NO: 4653 - DNA, 21 bp, Artificial Sequence
  Synthetic construct
tgggacatataatatcgtccc

SEQ ID NO: 4654 - DNA, 21 bp, Artificial Sequence
  Synthetic construct
gggacatataatatcgtcccc

SEQ ID NO: 4655 - DNA, 21 bp, Artificial Sequence
  Synthetic construct
ggacatataatatcgtccccg

SEQ ID NO: 4656 - DNA, 21 bp, Artificial Sequence
  Synthetic construct
gacatataatatcgtccccgt

SEQ ID NO: 4657 - DNA, 21 bp, Artificial Sequence
  Synthetic construct
acatataatatcgtccccgta

SEQ ID NO: 4658 - DNA, 21 bp, Artificial Sequence
  Synthetic construct
catataatatcgtccccgtag

SEQ ID NO: 4659 - DNA, 21 bp, Artificial Sequence
  Synthetic construct
atataatatcgtccccgtaga

SEQ ID NO: 4660 - DNA, 21 bp, Artificial Sequence
  Synthetic construct
tataatatcgtccccgtagat

SEQ ID NO: 4661 - DNA, 21 bp, Artificial Sequence
  Synthetic construct
ataatatcgtccccgtagatg

SEQ ID NO: 4662 - DNA, 21 bp, Artificial Sequence
  Synthetic construct
taatatcgtccccgtagatgc

SEQ ID NO: 4663 - DNA, 21 bp, Artificial Sequence
  Synthetic construct
aatatcgtccccgtagatgcc

SEQ ID NO: 4664 - DNA, 21 bp, Artificial Sequence
  Synthetic construct
atatcgtccccgtagatgcct

SEQ ID NO: 4665 - DNA, 21 bp, Artificial Sequence
  Synthetic construct
tatcgtccccgtagatgccta

SEQ ID NO: 4666 - DNA, 21 bp, Artificial Sequence
  Synthetic construct
atcgtccccgtagatgcctat

SEQ ID NO: 4667 - DNA, 21 bp, Artificial Sequence
  Synthetic construct
tcgtccccgtagatgcctatg

SEQ ID NO: 4668 - DNA, 21 bp, Artificial Sequence
  Synthetic construct
cgtccccgtagatgcctatgg

SEQ ID NO: 4669 - DNA, 21 bp, Artificial Sequence
  Synthetic construct
gtccccgtagatgcctatggt

SEQ ID NO: 4670 - DNA, 21 bp, Artificial Sequence
  Synthetic construct
tccccgtagatgcctatggtt

SEQ ID NO: 4671 - DNA, 21 bp, Artificial Sequence
  Synthetic construct
ccccgtagatgcctatggttc

SEQ ID NO: 4672 - DNA, 21 bp, Artificial Sequence
  Synthetic construct
cccgtagatgcctatggttcc

SEQ ID NO: 4673 - DNA, 21 bp, Artificial Sequence
  Synthetic construct
ccgtagatgcctatggttccg

SEQ ID NO: 4674 - DNA, 21 bp, Artificial Sequence
  Synthetic construct
cgtagatgcctatggttccgg

SEQ ID NO: 4675 - DNA, 21 bp, Artificial Sequence
  Synthetic construct
gtagatgcctatggttccggc

SEQ ID NO: 4676 - DNA, 21 bp, Artificial Sequence
  Synthetic construct
tagatgcctatggttccggcg

SEQ ID NO: 4677 - DNA, 21 bp, Artificial Sequence
  Synthetic construct
agatgcctatggttccggcgt

SEQ ID NO: 4678 - DNA, 21 bp, Artificial Sequence
  Synthetic construct
gatgcctatggttccggcgtt

SEQ ID NO: 4679 - DNA, 21 bp, Artificial Sequence
  Synthetic construct
atgcctatggttccggcgtta

SEQ ID NO: 4680 - DNA, 21 bp, Artificial Sequence
  Synthetic construct
tgcctatggttccggcgttac

SEQ ID NO: 4681 - DNA, 21 bp, Artificial Sequence
  Synthetic construct
gcctatggttccggcgttacc

SEQ ID NO: 4682 - DNA, 21 bp, Artificial Sequence
  Synthetic construct
cctatggttccggcgttacca

SEQ ID NO: 4683 - DNA, 21 bp, Artificial Sequence
  Synthetic construct
ctatggttccggcgttaccaa

SEQ ID NO: 4684 - DNA, 21 bp, Artificial Sequence
  Synthetic construct
tatggttccggcgttaccaaa

SEQ ID NO: 4685 - DNA, 21 bp, Artificial Sequence
  Synthetic construct
atggttccggcgttaccaaaa

SEQ ID NO: 4686 - DNA, 21 bp, Artificial Sequence
  Synthetic construct
tggttccggcgttaccaaaat

SEQ ID NO: 4687 - DNA, 21 bp, Artificial Sequence
  Synthetic construct
ggttccggcgttaccaaaatg

SEQ ID NO: 4688 - DNA, 21 bp, Artificial Sequence
  Synthetic construct
gttccggcgttaccaaaatgg

SEQ ID NO: 4689 - DNA, 21 bp, Artificial Sequence
  Synthetic construct
ttccggcgttaccaaaatgga

SEQ ID NO: 4690 - DNA, 21 bp, Artificial Sequence
  Synthetic construct
tccggcgttaccaaaatggat

SEQ ID NO: 4691 - DNA, 21 bp, Artificial Sequence
  Synthetic construct
ccggcgttaccaaaatggatt

SEQ ID NO: 4692 - DNA, 21 bp, Artificial Sequence
  Synthetic construct
cggcgttaccaaaatggattt

SEQ ID NO: 4693 - DNA, 21 bp, Artificial Sequence
  Synthetic construct
ggcgttaccaaaatggatttg

SEQ ID NO: 4694 - DNA, 21 bp, Artificial Sequence
  Synthetic construct
gcgttaccaaaatggatttgg

SEQ ID NO: 4695 - DNA, 21 bp, Artificial Sequence
  Synthetic construct
cgttaccaaaatggatttggg

SEQ ID NO: 4696 - DNA, 21 bp, Artificial Sequence
  Synthetic construct
gttaccaaaatggatttgggt

SEQ ID NO: 4697 - DNA, 21 bp, Artificial Sequence
  Synthetic construct
ttaccaaaatggatttgggtc

SEQ ID NO: 4698 - DNA, 21 bp, Artificial Sequence
  Synthetic construct
taccaaaatggatttgggtcg

SEQ ID NO: 4699 - DNA, 21 bp, Artificial Sequence
  Synthetic construct
accaaaatggatttgggtcgc

SEQ ID NO: 4700 - DNA, 21 bp, Artificial Sequence
  Synthetic construct
ccaaaatggatttgggtcgct

SEQ ID NO: 4701 - DNA, 21 bp, Artificial Sequence
  Synthetic construct
caaaatggatttgggtcgctt

SEQ ID NO: 4702 - DNA, 21 bp, Artificial Sequence
  Synthetic construct
aaaatggatttgggtcgcttt

SEQ ID NO: 4703 - DNA, 21 bp, Artificial Sequence
  Synthetic construct
aaatggatttgggtcgctttg

SEQ ID NO: 4704 - DNA, 21 bp, Artificial Sequence
  Synthetic construct
aatggatttgggtcgctttga

SEQ ID NO: 4705 - DNA, 21 bp, Artificial Sequence
  Synthetic construct
atggatttgggtcgctttgac

SEQ ID NO: 4706 - DNA, 21 bp, Artificial Sequence
  Synthetic construct
tggatttgggtcgctttgact

SEQ ID NO: 4707 - DNA, 21 bp, Artificial Sequence
  Synthetic construct
ggatttgggtcgctttgacta

SEQ ID NO: 4708 - DNA, 21 bp, Artificial Sequence
  Synthetic construct
gatttgggtcgctttgactat

SEQ ID NO: 4709 - DNA, 21 bp, Artificial Sequence
  Synthetic construct
atttgggtcgctttgactatt

SEQ ID NO: 4710 - DNA, 21 bp, Artificial Sequence
  Synthetic construct
tttgggtcgctttgactattg

SEQ ID NO: 4711 - DNA, 21 bp, Artificial Sequence
  Synthetic construct
ttgggtcgctttgactattgc

SEQ ID NO: 4712 - DNA, 21 bp, Artificial Sequence
  Synthetic construct
tgggtcgctttgactattgcc

SEQ ID NO: 4713 - DNA, 21 bp, Artificial Sequence
  Synthetic construct
gggtcgctttgactattgccc

SEQ ID NO: 4714 - DNA, 21 bp, Artificial Sequence
  Synthetic construct
ggtcgctttgactattgccca

SEQ ID NO: 4715 - DNA, 21 bp, Artificial Sequence
  Synthetic construct
gtcgctttgactattgcccag

SEQ ID NO: 4716 - DNA, 21 bp, Artificial Sequence
  Synthetic construct
tcgctttgactattgcccaga

SEQ ID NO: 4717 - DNA, 21 bp, Artificial Sequence
  Synthetic construct
cgctttgactattgcccagaa

SEQ ID NO: 4718 - DNA, 21 bp, Artificial Sequence
  Synthetic construct
gctttgactattgcccagaat

SEQ ID NO: 4719 - DNA, 21 bp, Artificial Sequence
  Synthetic construct
ctttgactattgcccagaata

SEQ ID NO: 4720 - DNA, 21 bp, Artificial Sequence
  Synthetic construct
tttgactattgcccagaatat

SEQ ID NO: 4721 - DNA, 21 bp, Artificial Sequence
  Synthetic construct
ttgactattgcccagaatatc

SEQ ID NO: 4722 - DNA, 21 bp, Artificial Sequence
  Synthetic construct
tgactattgcccagaatatca

SEQ ID NO: 4723 - DNA, 21 bp, Artificial Sequence
  Synthetic construct
gactattgcccagaatatcat

SEQ ID NO: 4724 - DNA, 21 bp, Artificial Sequence
  Synthetic construct
actattgcccagaatatcatg

SEQ ID NO: 4725 - DNA, 21 bp, Artificial Sequence
  Synthetic construct
ctattgcccagaatatcatgg

SEQ ID NO: 4726 - DNA, 21 bp, Artificial Sequence
  Synthetic construct
tattgcccagaatatcatgga

SEQ ID NO: 4727 - DNA, 21 bp, Artificial Sequence
  Synthetic construct
attgcccagaatatcatggac

SEQ ID NO: 4728 - DNA, 21 bp, Artificial Sequence
  Synthetic construct
ttgcccagaatatcatggact

SEQ ID NO: 4729 - DNA, 21 bp, Artificial Sequence
  Synthetic construct
tgcccagaatatcatggactc

SEQ ID NO: 4730 - DNA, 21 bp, Artificial Sequence
  Synthetic construct
gcccagaatatcatggactct

SEQ ID NO: 4731 - DNA, 21 bp, Artificial Sequence
  Synthetic construct
cccagaatatcatggactcta

SEQ ID NO: 4732 - DNA, 21 bp, Artificial Sequence
  Synthetic construct
ccagaatatcatggactctag

SEQ ID NO: 4733 - DNA, 21 bp, Artificial Sequence
  Synthetic construct
cagaatatcatggactctagc

SEQ ID NO: 4734 - DNA, 21 bp, Artificial Sequence
  Synthetic construct
agaatatcatggactctagct

SEQ ID NO: 4735 - DNA, 21 bp, Artificial Sequence
  Synthetic construct
gaatatcatggactctagctc

SEQ ID NO: 4736 - DNA, 21 bp, Artificial Sequence
  Synthetic construct
aatatcatggactctagctca

SEQ ID NO: 4737 - DNA, 21 bp, Artificial Sequence
  Synthetic construct
atatcatggactctagctcaa

SEQ ID NO: 4738 - DNA, 21 bp, Artificial Sequence
  Synthetic construct
tatcatggactctagctcaaa

SEQ ID NO: 4739 - DNA, 21 bp, Artificial Sequence
  Synthetic construct
atcatggactctagctcaaat

SEQ ID NO: 4740 - DNA, 21 bp, Artificial Sequence
  Synthetic construct
tcatggactctagctcaaatg

SEQ ID NO: 4741 - DNA, 21 bp, Artificial Sequence
  Synthetic construct
catggactctagctcaaatgt

SEQ ID NO: 4742 - DNA, 21 bp, Artificial Sequence
  Synthetic construct
atggactctagctcaaatgtg

SEQ ID NO: 4743 - DNA, 21 bp, Artificial Sequence
  Synthetic construct
tggactctagctcaaatgtga

SEQ ID NO: 4744 - DNA, 21 bp, Artificial Sequence
  Synthetic construct
ggactctagctcaaatgtgaa

SEQ ID NO: 4745 - DNA, 21 bp, Artificial Sequence
  Synthetic construct
gactctagctcaaatgtgaac

SEQ ID NO: 4746 - DNA, 21 bp, Artificial Sequence
  Synthetic construct
actctagctcaaatgtgaacc

SEQ ID NO: 4747 - DNA, 21 bp, Artificial Sequence
  Synthetic construct
ctctagctcaaatgtgaaccc

SEQ ID NO: 4748 - DNA, 21 bp, Artificial Sequence
  Synthetic construct
tctagctcaaatgtgaaccca

SEQ ID NO: 4749 - DNA, 21 bp, Artificial Sequence
  Synthetic construct
ctagctcaaatgtgaacccat

SEQ ID NO: 4750 - DNA, 21 bp, Artificial Sequence
  Synthetic construct
tagctcaaatgtgaacccatt

SEQ ID NO: 4751 - DNA, 21 bp, Artificial Sequence
  Synthetic construct
agctcaaatgtgaacccattt

SEQ ID NO: 4752 - DNA, 21 bp, Artificial Sequence
  Synthetic construct
gctcaaatgtgaacccatttc

SEQ ID NO: 4753 - DNA, 21 bp, Artificial Sequence
  Synthetic construct
ctcaaatgtgaacccatttcc

SEQ ID NO: 4754 - DNA, 21 bp, Artificial Sequence
  Synthetic construct
tcaaatgtgaacccatttccc

SEQ ID NO: 4755 - DNA, 21 bp, Artificial Sequence
  Synthetic construct
caaatgtgaacccatttccca

SEQ ID NO: 4756 - DNA, 21 bp, Artificial Sequence
  Synthetic construct
aaatgtgaacccatttcccat

SEQ ID NO: 4757 - DNA, 21 bp, Artificial Sequence
  Synthetic construct
aatgtgaacccatttcccatt

SEQ ID NO: 4758 - DNA, 21 bp, Artificial Sequence
  Synthetic construct
atgtgaacccatttcccattg

SEQ ID NO: 4759 - DNA, 21 bp, Artificial Sequence
  Synthetic construct
tgtgaacccatttcccattgt

SEQ ID NO: 4760 - DNA, 21 bp, Artificial Sequence
  Synthetic construct
gtgaacccatttcccattgtg

SEQ ID NO: 4761 - DNA, 21 bp, Artificial Sequence
  Synthetic construct
tgaacccatttcccattgtgg

SEQ ID NO: 4762 - DNA, 21 bp, Artificial Sequence
  Synthetic construct
gaacccatttcccattgtgga

SEQ ID NO: 4763 - DNA, 21 bp, Artificial Sequence
  Synthetic construct
aacccatttcccattgtggaa

SEQ ID NO: 4764 - DNA, 21 bp, Artificial Sequence
  Synthetic construct
acccatttcccattgtggaaa

SEQ ID NO: 4765 - DNA, 21 bp, Artificial Sequence
  Synthetic construct
cccatttcccattgtggaaaa

SEQ ID NO: 4766 - DNA, 21 bp, Artificial Sequence
  Synthetic construct
ccatttcccattgtggaaaat

SEQ ID NO: 4767 - DNA, 21 bp, Artificial Sequence
  Synthetic construct
catttcccattgtggaaaata

SEQ ID NO: 4768 - DNA, 21 bp, Artificial Sequence
  Synthetic construct
atttcccattgtggaaaatag

SEQ ID NO: 4769 - DNA, 21 bp, Artificial Sequence
  Synthetic construct
tttcccattgtggaaaatagt

SEQ ID NO: 4770 - DNA, 21 bp, Artificial Sequence
  Synthetic construct
ttcccattgtggaaaatagtt

SEQ ID NO: 4771 - DNA, 21 bp, Artificial Sequence
  Synthetic construct
tcccattgtggaaaatagttc

SEQ ID NO: 4772 - DNA, 21 bp, Artificial Sequence
  Synthetic construct
cccattgtggaaaatagttcc

SEQ ID NO: 4773 - DNA, 21 bp, Artificial Sequence
  Synthetic construct
ccattgtggaaaatagttccc

SEQ ID NO: 4774 - DNA, 21 bp, Artificial Sequence
  Synthetic construct
cattgtggaaaatagttccca

SEQ ID NO: 4775 - DNA, 21 bp, Artificial Sequence
  Synthetic construct
attgtggaaaatagttcccat

SEQ ID NO: 4776 - DNA, 21 bp, Artificial Sequence
  Synthetic construct
ttgtggaaaatagttcccatc

SEQ ID NO: 4777 - DNA, 21 bp, Artificial Sequence
  Synthetic construct
tgtggaaaatagttcccatcg

SEQ ID NO: 4778 - DNA, 21 bp, Artificial Sequence
  Synthetic construct
gtggaaaatagttcccatcgt

SEQ ID NO: 4779 - DNA, 21 bp, Artificial Sequence
  Synthetic construct
tggaaaatagttcccatcgta

SEQ ID NO: 4780 - DNA, 21 bp, Artificial Sequence
  Synthetic construct
ggaaaatagttcccatcgtat

SEQ ID NO: 4781 - DNA, 21 bp, Artificial Sequence
  Synthetic construct
gaaaatagttcccatcgtatc

SEQ ID NO: 4782 - DNA, 21 bp, Artificial Sequence
  Synthetic construct
aaaatagttcccatcgtatcg

SEQ ID NO: 4783 - DNA, 21 bp, Artificial Sequence
  Synthetic construct
aaatagttcccatcgtatcgt

SEQ ID NO: 4784 - DNA, 21 bp, Artificial Sequence
  Synthetic construct
aatagttcccatcgtatcgtc

SEQ ID NO: 4785 - DNA, 21 bp, Artificial Sequence
  Synthetic construct
atagttcccatcgtatcgtct

SEQ ID NO: 4786 - DNA, 21 bp, Artificial Sequence
  Synthetic construct
tagttcccatcgtatcgtctc

SEQ ID NO: 4787 - DNA, 21 bp, Artificial Sequence
  Synthetic construct
agttcccatcgtatcgtctcg

SEQ ID NO: 4788 - DNA, 21 bp, Artificial Sequence
  Synthetic construct
gttcccatcgtatcgtctcgc

SEQ ID NO: 4789 - DNA, 21 bp, Artificial Sequence
  Synthetic construct
ttcccatcgtatcgtctcgcc

SEQ ID NO: 4790 - DNA, 21 bp, Artificial Sequence
  Synthetic construct
tcccatcgtatcgtctcgcca

SEQ ID NO: 4791 - DNA, 21 bp, Artificial Sequence
  Synthetic construct
cccatcgtatcgtctcgccat

SEQ ID NO: 4792 - DNA, 21 bp, Artificial Sequence
  Synthetic construct
ccatcgtatcgtctcgccatc

SEQ ID NO: 4793 - DNA, 21 bp, Artificial Sequence
  Synthetic construct
catcgtatcgtctcgccatct

SEQ ID NO: 4794 - DNA, 21 bp, Artificial Sequence
  Synthetic construct
atcgtatcgtctcgccatcta

SEQ ID NO: 4795 - DNA, 21 bp, Artificial Sequence
  Synthetic construct
tcgtatcgtctcgccatctac

SEQ ID NO: 4796 - DNA, 21 bp, Artificial Sequence
  Synthetic construct
cgtatcgtctcgccatctacg

SEQ ID NO: 4797 - DNA, 21 bp, Artificial Sequence
  Synthetic construct
gtatcgtctcgccatctacga

SEQ ID NO: 4798 - DNA, 21 bp, Artificial Sequence
  Synthetic construct
tatcgtctcgccatctacgat

SEQ ID NO: 4799 - DNA, 21 bp, Artificial Sequence
  Synthetic construct
atcgtctcgccatctacgatt

SEQ ID NO: 4800 - DNA, 21 bp, Artificial Sequence
  Synthetic construct
tcgtctcgccatctacgattc

SEQ ID NO: 4801 - DNA, 21 bp, Artificial Sequence
  Synthetic construct
cgtctcgccatctacgattcc

SEQ ID NO: 4802 - DNA, 21 bp, Artificial Sequence
  Synthetic construct
gtctcgccatctacgattccg

SEQ ID NO: 4803 - DNA, 21 bp, Artificial Sequence
  Synthetic construct
tctcgccatctacgattccgt

SEQ ID NO: 4804 - DNA, 21 bp, Artificial Sequence
  Synthetic construct
ctcgccatctacgattccgta

SEQ ID NO: 4805 - DNA, 21 bp, Artificial Sequence
  Synthetic construct
tcgccatctacgattccgtag

SEQ ID NO: 4806 - DNA, 21 bp, Artificial Sequence
  Synthetic construct
cgccatctacgattccgtagt

SEQ ID NO: 4807 - DNA, 21 bp, Artificial Sequence
  Synthetic construct
gccatctacgattccgtagtg

SEQ ID NO: 4808 - DNA, 21 bp, Artificial Sequence
  Synthetic construct
ccatctacgattccgtagtgt

SEQ ID NO: 4809 - DNA, 21 bp, Artificial Sequence
  Synthetic construct
catctacgattccgtagtgtg

SEQ ID NO: 4810 - DNA, 21 bp, Artificial Sequence
  Synthetic construct
atctacgattccgtagtgtga

SEQ ID NO: 4811 - DNA, 21 bp, Artificial Sequence
  Synthetic construct
tctacgattccgtagtgtgag

SEQ ID NO: 4812 - DNA, 21 bp, Artificial Sequence
  Synthetic construct
ctacgattccgtagtgtgagc

SEQ ID NO: 4813 - DNA, 21 bp, Artificial Sequence
  Synthetic construct
tacgattccgtagtgtgagcg

SEQ ID NO: 4814 - DNA, 21 bp, Artificial Sequence
  Synthetic construct
acgattccgtagtgtgagcgg

SEQ ID NO: 4815 - DNA, 21 bp, Artificial Sequence
  Synthetic construct
cgattccgtagtgtgagcgga

SEQ ID NO: 4816 - DNA, 21 bp, Artificial Sequence
  Synthetic construct
gattccgtagtgtgagcggat

SEQ ID NO: 4817 - DNA, 21 bp, Artificial Sequence
  Synthetic construct
attccgtagtgtgagcggata

SEQ ID NO: 4818 - DNA, 21 bp, Artificial Sequence
  Synthetic construct
ttccgtagtgtgagcggatac

SEQ ID NO: 4819 - DNA, 21 bp, Artificial Sequence
  Synthetic construct
tccgtagtgtgagcggatacg

SEQ ID NO: 4820 - DNA, 21 bp, Artificial Sequence
  Synthetic construct
ccgtagtgtgagcggatacga

SEQ ID NO: 4821 - DNA, 21 bp, Artificial Sequence
  Synthetic construct
cgtagtgtgagcggatacgat

SEQ ID NO: 4822 - DNA, 21 bp, Artificial Sequence
  Synthetic construct
gtagtgtgagcggatacgatc

SEQ ID NO: 4823 - DNA, 21 bp, Artificial Sequence
  Synthetic construct
tagtgtgagcggatacgatcg

SEQ ID NO: 4824 - DNA, 21 bp, Artificial Sequence
  Synthetic construct
agtgtgagcggatacgatcga

SEQ ID NO: 4825 - DNA, 21 bp, Artificial Sequence
  Synthetic construct
gtgtgagcggatacgatcgag

SEQ ID NO: 4826 - DNA, 21 bp, Artificial Sequence
  Synthetic construct
tgtgagcggatacgatcgaga

SEQ ID NO: 4827 - DNA, 21 bp, Artificial Sequence
  Synthetic construct
gtgagcggatacgatcgagat

SEQ ID NO: 4828 - DNA, 21 bp, Artificial Sequence
  Synthetic construct
tgagcggatacgatcgagata

SEQ ID NO: 4829 - DNA, 21 bp, Artificial Sequence
  Synthetic construct
gagcggatacgatcgagatat

SEQ ID NO: 4830 - DNA, 21 bp, Artificial Sequence
  Synthetic construct
agcggatacgatcgagatatg

SEQ ID NO: 4831 - DNA, 21 bp, Artificial Sequence
  Synthetic construct
gcggatacgatcgagatatga

SEQ ID NO: 4832 - DNA, 21 bp, Artificial Sequence
  Synthetic construct
cggatacgatcgagatatgaa

SEQ ID NO: 4833 - DNA, 21 bp, Artificial Sequence
  Synthetic construct
ggatacgatcgagatatgaat

SEQ ID NO: 4834 - DNA, 21 bp, Artificial Sequence
  Synthetic construct
gatacgatcgagatatgaata

SEQ ID NO: 4835 - DNA, 21 bp, Artificial Sequence
  Synthetic construct
atacgatcgagatatgaatat

SEQ ID NO: 4836 - DNA, 21 bp, Artificial Sequence
  Synthetic construct
tacgatcgagatatgaatata

SEQ ID NO: 4837 - DNA, 21 bp, Artificial Sequence
  Synthetic construct
acgatcgagatatgaatatag

SEQ ID NO: 4838 - DNA, 21 bp, Artificial Sequence
  Synthetic construct
cgatcgagatatgaatatagc

SEQ ID NO: 4839 - DNA, 21 bp, Artificial Sequence
  Synthetic construct
gatcgagatatgaatatagct

SEQ ID NO: 4840 - DNA, 21 bp, Artificial Sequence
  Synthetic construct
atcgagatatgaatatagctc

SEQ ID NO: 4841 - DNA, 21 bp, Artificial Sequence
  Synthetic construct
tcgagatatgaatatagctct

SEQ ID NO: 4842 - DNA, 21 bp, Artificial Sequence
  Synthetic construct
cgagatatgaatatagctctg

SEQ ID NO: 4843 - DNA, 21 bp, Artificial Sequence
  Synthetic construct
gagatatgaatatagctctgg

SEQ ID NO: 4844 - DNA, 21 bp, Artificial Sequence
  Synthetic construct
agatatgaatatagctctggt

SEQ ID NO: 4845 - DNA, 21 bp, Artificial Sequence
  Synthetic construct
gatatgaatatagctctggtg

SEQ ID NO: 4846 - DNA, 21 bp, Artificial Sequence
  Synthetic construct
atatgaatatagctctggtgg

SEQ ID NO: 4847 - DNA, 21 bp, Artificial Sequence
  Synthetic construct
tatgaatatagctctggtggg

SEQ ID NO: 4848 - DNA, 21 bp, Artificial Sequence
  Synthetic construct
atgaatatagctctggtggga

SEQ ID NO: 4849 - DNA, 21 bp, Artificial Sequence
  Synthetic construct
tgaatatagctctggtgggag

SEQ ID NO: 4850 - DNA, 21 bp, Artificial Sequence
  Synthetic construct
gaatatagctctggtgggaga

SEQ ID NO: 4851 - DNA, 21 bp, Artificial Sequence
  Synthetic construct
aatatagctctggtgggagaa

SEQ ID NO: 4852 - DNA, 21 bp, Artificial Sequence
  Synthetic construct
atatagctctggtgggagaaa

SEQ ID NO: 4853 - DNA, 21 bp, Artificial Sequence
  Synthetic construct
tatagctctggtgggagaaaa

SEQ ID NO: 4854 - DNA, 21 bp, Artificial Sequence
  Synthetic construct
atagctctggtgggagaaaac

SEQ ID NO: 4855 - DNA, 21 bp, Artificial Sequence
  Synthetic construct
tagctctggtgggagaaaact

SEQ ID NO: 4856 - DNA, 21 bp, Artificial Sequence
  Synthetic construct
agctctggtgggagaaaactc

SEQ ID NO: 4857 - DNA, 21 bp, Artificial Sequence
  Synthetic construct
gctctggtgggagaaaactcc

SEQ ID NO: 4858 - DNA, 21 bp, Artificial Sequence
  Synthetic construct
ctctggtgggagaaaactcca

SEQ ID NO: 4859 - DNA, 21 bp, Artificial Sequence
  Synthetic construct
tctggtgggagaaaactccac

SEQ ID NO: 4860 - DNA, 21 bp, Artificial Sequence
  Synthetic construct
ctggtgggagaaaactccaca

SEQ ID NO: 4861 - DNA, 21 bp, Artificial Sequence
  Synthetic construct
tggtgggagaaaactccacac

SEQ ID NO: 4862 - DNA, 21 bp, Artificial Sequence
  Synthetic construct
ggtgggagaaaactccacacc

SEQ ID NO: 4863 - DNA, 21 bp, Artificial Sequence
  Synthetic construct
gtgggagaaaactccacacca

SEQ ID NO: 4864 - DNA, 21 bp, Artificial Sequence
  Synthetic construct
tgggagaaaactccacaccag

SEQ ID NO: 4865 - DNA, 21 bp, Artificial Sequence
  Synthetic construct
gggagaaaactccacaccagg

SEQ ID NO: 4866 - DNA, 21 bp, Artificial Sequence
  Synthetic construct
ggagaaaactccacaccaggc

SEQ ID NO: 4867 - DNA, 21 bp, Artificial Sequence
  Synthetic construct
gagaaaactccacaccaggcg

SEQ ID NO: 4868 - DNA, 21 bp, Artificial Sequence
  Synthetic construct
agaaaactccacaccaggcga

SEQ ID NO: 4869 - DNA, 21 bp, Artificial Sequence
  Synthetic construct
gaaaactccacaccaggcgat

SEQ ID NO: 4870 - DNA, 21 bp, Artificial Sequence
  Synthetic construct
aaaactccacaccaggcgatc

SEQ ID NO: 4871 - DNA, 21 bp, Artificial Sequence
  Synthetic construct
aaactccacaccaggcgatcg

SEQ ID NO: 4872 - DNA, 21 bp, Artificial Sequence
  Synthetic construct
aactccacaccaggcgatcgg

SEQ ID NO: 4873 - DNA, 21 bp, Artificial Sequence
  Synthetic construct
actccacaccaggcgatcgga

SEQ ID NO: 4874 - DNA, 21 bp, Artificial Sequence
  Synthetic construct
ctccacaccaggcgatcggag

SEQ ID NO: 4875 - DNA, 21 bp, Artificial Sequence
  Synthetic construct
tccacaccaggcgatcggaga

SEQ ID NO: 4876 - DNA, 21 bp, Artificial Sequence
  Synthetic construct
ccacaccaggcgatcggagat

SEQ ID NO: 4877 - DNA, 21 bp, Artificial Sequence
  Synthetic construct
cacaccaggcgatcggagatg

SEQ ID NO: 4878 - DNA, 21 bp, Artificial Sequence
  Synthetic construct
acaccaggcgatcggagatgg

SEQ ID NO: 4879 - DNA, 21 bp, Artificial Sequence
  Synthetic construct
caccaggcgatcggagatgga

SEQ ID NO: 4880 - DNA, 21 bp, Artificial Sequence
  Synthetic construct
accaggcgatcggagatggaa

SEQ ID NO: 4881 - DNA, 21 bp, Artificial Sequence
  Synthetic construct
ccaggcgatcggagatggaat

SEQ ID NO: 4882 - DNA, 21 bp, Artificial Sequence
  Synthetic construct
caggcgatcggagatggaatc

SEQ ID NO: 4883 - DNA, 21 bp, Artificial Sequence
  Synthetic construct
aggcgatcggagatggaatcg

SEQ ID NO: 4884 - DNA, 21 bp, Artificial Sequence
  Synthetic construct
ggcgatcggagatggaatcgg

SEQ ID NO: 4885 - DNA, 21 bp, Artificial Sequence
  Synthetic construct
gcgatcggagatggaatcgga

SEQ ID NO: 4886 - DNA, 21 bp, Artificial Sequence
  Synthetic construct
cgatcggagatggaatcggat

SEQ ID NO: 4887 - DNA, 21 bp, Artificial Sequence
  Synthetic construct
gatcggagatggaatcggatg

SEQ ID NO: 4888 - DNA, 21 bp, Artificial Sequence
  Synthetic construct
atcggagatggaatcggatgc

SEQ ID NO: 4889 - DNA, 21 bp, Artificial Sequence
  Synthetic construct
tcggagatggaatcggatgca

SEQ ID NO: 4890 - DNA, 21 bp, Artificial Sequence
  Synthetic construct
cggagatggaatcggatgcag

SEQ ID NO: 4891 - DNA, 21 bp, Artificial Sequence
  Synthetic construct
ggagatggaatcggatgcaga

SEQ ID NO: 4892 - DNA, 21 bp, Artificial Sequence
  Synthetic construct
gagatggaatcggatgcagac

SEQ ID NO: 4893 - DNA, 21 bp, Artificial Sequence
  Synthetic construct
agatggaatcggatgcagacg

SEQ ID NO: 4894 - DNA, 21 bp, Artificial Sequence
  Synthetic construct
gatggaatcggatgcagacga

SEQ ID NO: 4895 - DNA, 21 bp, Artificial Sequence
  Synthetic construct
atggaatcggatgcagacgat

SEQ ID NO: 4896 - DNA, 21 bp, Artificial Sequence
  Synthetic construct
tggaatcggatgcagacgata

SEQ ID NO: 4897 - DNA, 21 bp, Artificial Sequence
  Synthetic construct
ggaatcggatgcagacgataa

SEQ ID NO: 4898 - DNA, 21 bp, Artificial Sequence
  Synthetic construct
gaatcggatgcagacgataag

SEQ ID NO: 4899 - DNA, 21 bp, Artificial Sequence
  Synthetic construct
aatcggatgcagacgataagt

SEQ ID NO: 4900 - DNA, 21 bp, Artificial Sequence
  Synthetic construct
atcggatgcagacgataagtc

SEQ ID NO: 4901 - DNA, 21 bp, Artificial Sequence
  Synthetic construct
tcggatgcagacgataagtct

SEQ ID NO: 4902 - DNA, 21 bp, Artificial Sequence
  Synthetic construct
cggatgcagacgataagtcta

SEQ ID NO: 4903 - DNA, 21 bp, Artificial Sequence
  Synthetic construct
ggatgcagacgataagtctat

SEQ ID NO: 4904 - DNA, 21 bp, Artificial Sequence
  Synthetic construct
gatgcagacgataagtctatc

SEQ ID NO: 4905 - DNA, 21 bp, Artificial Sequence
  Synthetic construct
atgcagacgataagtctatcg

SEQ ID NO: 4906 - DNA, 21 bp, Artificial Sequence
  Synthetic construct
tgcagacgataagtctatcgt

SEQ ID NO: 4907 - DNA, 21 bp, Artificial Sequence
  Synthetic construct
gcagacgataagtctatcgtc

SEQ ID NO: 4908 - DNA, 21 bp, Artificial Sequence
  Synthetic construct
cagacgataagtctatcgtcg

SEQ ID NO: 4909 - DNA, 21 bp, Artificial Sequence
  Synthetic construct
agacgataagtctatcgtcgc

SEQ ID NO: 4910 - DNA, 21 bp, Artificial Sequence
  Synthetic construct
gacgataagtctatcgtcgca

SEQ ID NO: 4911 - DNA, 21 bp, Artificial Sequence
  Synthetic construct
acgataagtctatcgtcgcaa

SEQ ID NO: 4912 - DNA, 21 bp, Artificial Sequence
  Synthetic construct
cgataagtctatcgtcgcaag

SEQ ID NO: 4913 - DNA, 21 bp, Artificial Sequence
  Synthetic construct
gataagtctatcgtcgcaagc

SEQ ID NO: 4914 - DNA, 21 bp, Artificial Sequence
  Synthetic construct
ataagtctatcgtcgcaagcg

SEQ ID NO: 4915 - DNA, 21 bp, Artificial Sequence
  Synthetic construct
taagtctatcgtcgcaagcga

SEQ ID NO: 4916 - DNA, 21 bp, Artificial Sequence
  Synthetic construct
aagtctatcgtcgcaagcgaa

SEQ ID NO: 4917 - DNA, 21 bp, Artificial Sequence
  Synthetic construct
agtctatcgtcgcaagcgaac

SEQ ID NO: 4918 - DNA, 21 bp, Artificial Sequence
  Synthetic construct
gtctatcgtcgcaagcgaacc

SEQ ID NO: 4919 - DNA, 21 bp, Artificial Sequence
  Synthetic construct
tctatcgtcgcaagcgaacca

SEQ ID NO: 4920 - DNA, 21 bp, Artificial Sequence
  Synthetic construct
ctatcgtcgcaagcgaaccat

SEQ ID NO: 4921 - DNA, 21 bp, Artificial Sequence
  Synthetic construct
tatcgtcgcaagcgaaccatc

SEQ ID NO: 4922 - DNA, 21 bp, Artificial Sequence
  Synthetic construct
atcgtcgcaagcgaaccatct

SEQ ID NO: 4923 - DNA, 21 bp, Artificial Sequence
  Synthetic construct
tcgtcgcaagcgaaccatcta

SEQ ID NO: 4924 - DNA, 21 bp, Artificial Sequence
  Synthetic construct
cgtcgcaagcgaaccatctac

SEQ ID NO: 4925 - DNA, 21 bp, Artificial Sequence
  Synthetic construct
gtcgcaagcgaaccatctacg

SEQ ID NO: 4926 - DNA, 21 bp, Artificial Sequence
  Synthetic construct
tcgcaagcgaaccatctacgc

SEQ ID NO: 4927 - DNA, 21 bp, Artificial Sequence
  Synthetic construct
cgcaagcgaaccatctacgct

SEQ ID NO: 4928 - DNA, 21 bp, Artificial Sequence
  Synthetic construct
gcaagcgaaccatctacgctg

SEQ ID NO: 4929 - DNA, 21 bp, Artificial Sequence
  Synthetic construct
caagcgaaccatctacgctgc

SEQ ID NO: 4930 - DNA, 21 bp, Artificial Sequence
  Synthetic construct
aagcgaaccatctacgctgcc

SEQ ID NO: 4931 - DNA, 21 bp, Artificial Sequence
  Synthetic construct
agcgaaccatctacgctgccc

SEQ ID NO: 4932 - DNA, 21 bp, Artificial Sequence
  Synthetic construct
gcgaaccatctacgctgccct

SEQ ID NO: 4933 - DNA, 21 bp, Artificial Sequence
  Synthetic construct
cgaaccatctacgctgccctg

SEQ ID NO: 4934 - DNA, 21 bp, Artificial Sequence
  Synthetic construct
gaaccatctacgctgccctgc

SEQ ID NO: 4935 - DNA, 21 bp, Artificial Sequence
  Synthetic construct
aaccatctacgctgccctgct

SEQ ID NO: 4936 - DNA, 21 bp, Artificial Sequence
  Synthetic construct
accatctacgctgccctgctg

SEQ ID NO: 4937 - DNA, 21 bp, Artificial Sequence
  Synthetic construct
ccatctacgctgccctgctga

SEQ ID NO: 4938 - DNA, 21 bp, Artificial Sequence
  Synthetic construct
catctacgctgccctgctgag

SEQ ID NO: 4939 - DNA, 21 bp, Artificial Sequence
  Synthetic construct
atctacgctgccctgctgagc

SEQ ID NO: 4940 - DNA, 21 bp, Artificial Sequence
  Synthetic construct
tctacgctgccctgctgagcc

SEQ ID NO: 4941 - DNA, 21 bp, Artificial Sequence
  Synthetic construct
ctacgctgccctgctgagcca

SEQ ID NO: 4942 - DNA, 21 bp, Artificial Sequence
  Synthetic construct
tacgctgccctgctgagccag

SEQ ID NO: 4943 - DNA, 21 bp, Artificial Sequence
  Synthetic construct
acgctgccctgctgagccaga

SEQ ID NO: 4944 - DNA, 21 bp, Artificial Sequence
  Synthetic construct
cgctgccctgctgagccagac

SEQ ID NO: 4945 - DNA, 21 bp, Artificial Sequence
  Synthetic construct
gctgccctgctgagccagacg

SEQ ID NO: 4946 - DNA, 21 bp, Artificial Sequence
  Synthetic construct
ctgccctgctgagccagacgc

SEQ ID NO: 4947 - DNA, 21 bp, Artificial Sequence
  Synthetic construct
tgccctgctgagccagacgct

SEQ ID NO: 4948 - DNA, 21 bp, Artificial Sequence
  Synthetic construct
gccctgctgagccagacgctg

SEQ ID NO: 4949 - DNA, 21 bp, Artificial Sequence
  Synthetic construct
ccctgctgagccagacgctgg

SEQ ID NO: 4950 - DNA, 21 bp, Artificial Sequence
  Synthetic construct
cctgctgagccagacgctggt

SEQ ID NO: 4951 - DNA, 21 bp, Artificial Sequence
  Synthetic construct
ctgctgagccagacgctggtt

SEQ ID NO: 4952 - DNA, 21 bp, Artificial Sequence
  Synthetic construct
tgctgagccagacgctggttg

SEQ ID NO: 4953 - DNA, 21 bp, Artificial Sequence
  Synthetic construct
gctgagccagacgctggttga

SEQ ID NO: 4954 - DNA, 21 bp, Artificial Sequence
  Synthetic construct
ctgagccagacgctggttgat

SEQ ID NO: 4955 - DNA, 21 bp, Artificial Sequence
  Synthetic construct
tgagccagacgctggttgatc

SEQ ID NO: 4956 - DNA, 21 bp, Artificial Sequence
  Synthetic construct
gagccagacgctggttgatcg

SEQ ID NO: 4957 - DNA, 21 bp, Artificial Sequence
  Synthetic construct
agccagacgctggttgatcga

SEQ ID NO: 4958 - DNA, 21 bp, Artificial Sequence
  Synthetic construct
gccagacgctggttgatcgat

SEQ ID NO: 4959 - DNA, 21 bp, Artificial Sequence
  Synthetic construct
ccagacgctggttgatcgatt

SEQ ID NO: 4960 - DNA, 21 bp, Artificial Sequence
  Synthetic construct
cagacgctggttgatcgattg

SEQ ID NO: 4961 - DNA, 21 bp, Artificial Sequence
  Synthetic construct
agacgctggttgatcgattga

SEQ ID NO: 4962 - DNA, 21 bp, Artificial Sequence
  Synthetic construct
gacgctggttgatcgattgat

SEQ ID NO: 4963 - DNA, 21 bp, Artificial Sequence
  Synthetic construct
acgctggttgatcgattgatc

SEQ ID NO: 4964 - DNA, 21 bp, Artificial Sequence
  Synthetic construct
cgctggttgatcgattgatca

SEQ ID NO: 4965 - DNA, 21 bp, Artificial Sequence
  Synthetic construct
gctggttgatcgattgatcat

SEQ ID NO: 4966 - DNA, 21 bp, Artificial Sequence
  Synthetic construct
ctggttgatcgattgatcatt

SEQ ID NO: 4967 - DNA, 21 bp, Artificial Sequence
  Synthetic construct
tggttgatcgattgatcattc

SEQ ID NO: 4968 - DNA, 21 bp, Artificial Sequence
  Synthetic construct
ggttgatcgattgatcattca

SEQ ID NO: 4969 - DNA, 21 bp, Artificial Sequence
  Synthetic construct
gttgatcgattgatcattcag

SEQ ID NO: 4970 - DNA, 21 bp, Artificial Sequence
  Synthetic construct
ttgatcgattgatcattcagg

SEQ ID NO: 4971 - DNA, 21 bp, Artificial Sequence
  Synthetic construct
tgatcgattgatcattcaggt

SEQ ID NO: 4972 - DNA, 21 bp, Artificial Sequence
  Synthetic construct
gatcgattgatcattcaggtc

SEQ ID NO: 4973 - DNA, 21 bp, Artificial Sequence
  Synthetic construct
atcgattgatcattcaggtct

SEQ ID NO: 4974 - DNA, 21 bp, Artificial Sequence
  Synthetic construct
tcgattgatcattcaggtcta

SEQ ID NO: 4975 - DNA, 21 bp, Artificial Sequence
  Synthetic construct
cgattgatcattcaggtctat

SEQ ID NO: 4976 - DNA, 21 bp, Artificial Sequence
  Synthetic construct
gattgatcattcaggtctata

SEQ ID NO: 4977 - DNA, 21 bp, Artificial Sequence
  Synthetic construct
attgatcattcaggtctatac

SEQ ID NO: 4978 - DNA, 21 bp, Artificial Sequence
  Synthetic construct
ttgatcattcaggtctatacc

SEQ ID NO: 4979 - DNA, 21 bp, Artificial Sequence
  Synthetic construct
tgatcattcaggtctatacca

SEQ ID NO: 4980 - DNA, 21 bp, Artificial Sequence
  Synthetic construct
gatcattcaggtctataccaa

SEQ ID NO: 4981 - DNA, 21 bp, Artificial Sequence
  Synthetic construct
atcattcaggtctataccaac

SEQ ID NO: 4982 - DNA, 21 bp, Artificial Sequence
  Synthetic construct
tcattcaggtctataccaacg

SEQ ID NO: 4983 - DNA, 21 bp, Artificial Sequence
  Synthetic construct
cattcaggtctataccaacgg

SEQ ID NO: 4984 - DNA, 21 bp, Artificial Sequence
  Synthetic construct
attcaggtctataccaacgga

SEQ ID NO: 4985 - DNA, 21 bp, Artificial Sequence
  Synthetic construct
ttcaggtctataccaacggat

SEQ ID NO: 4986 - DNA, 21 bp, Artificial Sequence
  Synthetic construct
tcaggtctataccaacggatt

SEQ ID NO: 4987 - DNA, 21 bp, Artificial Sequence
  Synthetic construct
caggtctataccaacggattt

SEQ ID NO: 4988 - DNA, 21 bp, Artificial Sequence
  Synthetic construct
aggtctataccaacggatttg

SEQ ID NO: 4989 - DNA, 21 bp, Artificial Sequence
  Synthetic construct
ggtctataccaacggatttga

SEQ ID NO: 4990 - DNA, 21 bp, Artificial Sequence
  Synthetic construct
gtctataccaacggatttgag

SEQ ID NO: 4991 - DNA, 21 bp, Artificial Sequence
  Synthetic construct
tctataccaacggatttgagc

SEQ ID NO: 4992 - DNA, 21 bp, Artificial Sequence
  Synthetic construct
ctataccaacggatttgagcc

SEQ ID NO: 4993 - DNA, 21 bp, Artificial Sequence
  Synthetic construct
tataccaacggatttgagccg

SEQ ID NO: 4994 - DNA, 21 bp, Artificial Sequence
  Synthetic construct
ataccaacggatttgagccgg

SEQ ID NO: 4995 - DNA, 21 bp, Artificial Sequence
  Synthetic construct
taccaacggatttgagccggc

SEQ ID NO: 4996 - DNA, 21 bp, Artificial Sequence
  Synthetic construct
accaacggatttgagccggcg

SEQ ID NO: 4997 - DNA, 21 bp, Artificial Sequence
  Synthetic construct
ccaacggatttgagccggcgt

SEQ ID NO: 4998 - DNA, 21 bp, Artificial Sequence
  Synthetic construct
caacggatttgagccggcgtc

SEQ ID NO: 4999 - DNA, 21 bp, Artificial Sequence
  Synthetic construct
aacggatttgagccggcgtct

SEQ ID NO: 5000 - DNA, 21 bp, Artificial Sequence
  Synthetic construct
acggatttgagccggcgtctg

SEQ ID NO: 5001 - DNA, 21 bp, Artificial Sequence
  Synthetic construct
cggatttgagccggcgtctga

SEQ ID NO: 5002 - DNA, 21 bp, Artificial Sequence
  Synthetic construct
ggatttgagccggcgtctgat

SEQ ID NO: 5003 - DNA, 21 bp, Artificial Sequence
  Synthetic construct
gatttgagccggcgtctgatg

SEQ ID NO: 5004 - DNA, 21 bp, Artificial Sequence
  Synthetic construct
atttgagccggcgtctgatga

SEQ ID NO: 5005 - DNA, 21 bp, Artificial Sequence
  Synthetic construct
tttgagccggcgtctgatgaa

SEQ ID NO: 5006 - DNA, 21 bp, Artificial Sequence
  Synthetic construct
ttgagccggcgtctgatgaaa

SEQ ID NO: 5007 - DNA, 21 bp, Artificial Sequence
  Synthetic construct
tgagccggcgtctgatgaaag

SEQ ID NO: 5008 - DNA, 21 bp, Artificial Sequence
  Synthetic construct
gagccggcgtctgatgaaagc

SEQ ID NO: 5009 - DNA, 21 bp, Artificial Sequence
  Synthetic construct
agccggcgtctgatgaaagca

SEQ ID NO: 5010 - DNA, 21 bp, Artificial Sequence
  Synthetic construct
gccggcgtctgatgaaagcac

SEQ ID NO: 5011 - DNA, 21 bp, Artificial Sequence
  Synthetic construct
ccggcgtctgatgaaagcacc

SEQ ID NO: 5012 - DNA, 21 bp, Artificial Sequence
  Synthetic construct
cggcgtctgatgaaagcaccg

SEQ ID NO: 5013 - DNA, 21 bp, Artificial Sequence
  Synthetic construct
ggcgtctgatgaaagcaccga

SEQ ID NO: 5014 - DNA, 21 bp, Artificial Sequence
  Synthetic construct
gcgtctgatgaaagcaccgac

SEQ ID NO: 5015 - DNA, 21 bp, Artificial Sequence
  Synthetic construct
cgtctgatgaaagcaccgacc

SEQ ID NO: 5016 - DNA, 21 bp, Artificial Sequence
  Synthetic construct
gtctgatgaaagcaccgaccc

SEQ ID NO: 5017 - DNA, 21 bp, Artificial Sequence
  Synthetic construct
tctgatgaaagcaccgacccc

SEQ ID NO: 5018 - DNA, 21 bp, Artificial Sequence
  Synthetic construct
ctgatgaaagcaccgacccct

SEQ ID NO: 5019 - DNA, 21 bp, Artificial Sequence
  Synthetic construct
tgatgaaagcaccgacccctt

SEQ ID NO: 5020 - DNA, 21 bp, Artificial Sequence
  Synthetic construct
gatgaaagcaccgaccccttt

SEQ ID NO: 5021 - DNA, 21 bp, Artificial Sequence
  Synthetic construct
atgaaagcaccgacccctttc

SEQ ID NO: 5022 - DNA, 21 bp, Artificial Sequence
  Synthetic construct
tgaaagcaccgacccctttct

SEQ ID NO: 5023 - DNA, 21 bp, Artificial Sequence
  Synthetic construct
gaaagcaccgacccctttctg

SEQ ID NO: 5024 - DNA, 21 bp, Artificial Sequence
  Synthetic construct
aaagcaccgacccctttctgg

SEQ ID NO: 5025 - DNA, 21 bp, Artificial Sequence
  Synthetic construct
aagcaccgacccctttctgga

SEQ ID NO: 5026 - DNA, 21 bp, Artificial Sequence
  Synthetic construct
agcaccgacccctttctggag

SEQ ID NO: 5027 - DNA, 21 bp, Artificial Sequence
  Synthetic construct
gcaccgacccctttctggagg

SEQ ID NO: 5028 - DNA, 21 bp, Artificial Sequence
  Synthetic construct
caccgacccctttctggaggt

SEQ ID NO: 5029 - DNA, 21 bp, Artificial Sequence
  Synthetic construct
accgacccctttctggaggta

SEQ ID NO: 5030 - DNA, 21 bp, Artificial Sequence
  Synthetic construct
ccgacccctttctggaggtac

SEQ ID NO: 5031 - DNA, 21 bp, Artificial Sequence
  Synthetic construct
cgacccctttctggaggtaca

SEQ ID NO: 5032 - DNA, 21 bp, Artificial Sequence
  Synthetic construct
gacccctttctggaggtacat

SEQ ID NO: 5033 - DNA, 21 bp, Artificial Sequence
  Synthetic construct
acccctttctggaggtacata

SEQ ID NO: 5034 - DNA, 21 bp, Artificial Sequence
  Synthetic construct
cccctttctggaggtacatat

SEQ ID NO: 5035 - DNA, 21 bp, Artificial Sequence
  Synthetic construct
ccctttctggaggtacatatt

SEQ ID NO: 5036 - DNA, 21 bp, Artificial Sequence
  Synthetic construct
cctttctggaggtacatattc

SEQ ID NO: 5037 - DNA, 21 bp, Artificial Sequence
  Synthetic construct
ctttctggaggtacatattca

SEQ ID NO: 5038 - DNA, 21 bp, Artificial Sequence
  Synthetic construct
tttctggaggtacatattcat

SEQ ID NO: 5039 - DNA, 21 bp, Artificial Sequence
  Synthetic construct
ttctggaggtacatattcata

SEQ ID NO: 5040 - DNA, 21 bp, Artificial Sequence
  Synthetic construct
tctggaggtacatattcatat

SEQ ID NO: 5041 - DNA, 21 bp, Artificial Sequence
  Synthetic construct
ctggaggtacatattcatatc

SEQ ID NO: 5042 - DNA, 21 bp, Artificial Sequence
  Synthetic construct
tggaggtacatattcatatca

SEQ ID NO: 5043 - DNA, 21 bp, Artificial Sequence
  Synthetic construct
ggaggtacatattcatatcag

SEQ ID NO: 5044 - DNA, 21 bp, Artificial Sequence
  Synthetic construct
gaggtacatattcatatcagg

SEQ ID NO: 5045 - DNA, 21 bp, Artificial Sequence
  Synthetic construct
aggtacatattcatatcaggc

SEQ ID NO: 5046 - DNA, 21 bp, Artificial Sequence
  Synthetic construct
ggtacatattcatatcaggct

SEQ ID NO: 5047 - DNA, 21 bp, Artificial Sequence
  Synthetic construct
gtacatattcatatcaggctc

SEQ ID NO: 5048 - DNA, 21 bp, Artificial Sequence
  Synthetic construct
tacatattcatatcaggctcc

SEQ ID NO: 5049 - DNA, 21 bp, Artificial Sequence
  Synthetic construct
acatattcatatcaggctcct

SEQ ID NO: 5050 - DNA, 21 bp, Artificial Sequence
  Synthetic construct
catattcatatcaggctcctt

SEQ ID NO: 5051 - DNA, 21 bp, Artificial Sequence
  Synthetic construct
atattcatatcaggctcctta

SEQ ID NO: 5052 - DNA, 21 bp, Artificial Sequence
  Synthetic construct
tattcatatcaggctccttac

SEQ ID NO: 5053 - DNA, 21 bp, Artificial Sequence
  Synthetic construct
attcatatcaggctccttaca

SEQ ID NO: 5054 - DNA, 21 bp, Artificial Sequence
  Synthetic construct
ttcatatcaggctccttacag

SEQ ID NO: 5055 - DNA, 21 bp, Artificial Sequence
  Synthetic construct
tcatatcaggctccttacagg

SEQ ID NO: 5056 - DNA, 21 bp, Artificial Sequence
  Synthetic construct
catatcaggctccttacaggc

SEQ ID NO: 5057 - DNA, 21 bp, Artificial Sequence
  Synthetic construct
atatcaggctccttacaggca

SEQ ID NO: 5058 - DNA, 21 bp, Artificial Sequence
  Synthetic construct
tatcaggctccttacaggcag

SEQ ID NO: 5059 - DNA, 21 bp, Artificial Sequence
  Synthetic construct
atcaggctccttacaggcagc

SEQ ID NO: 5060 - DNA, 21 bp, Artificial Sequence
  Synthetic construct
tcaggctccttacaggcagcc

SEQ ID NO: 5061 - DNA, 21 bp, Artificial Sequence
  Synthetic construct
caggctccttacaggcagccc

SEQ ID NO: 5062 - DNA, 21 bp, Artificial Sequence
  Synthetic construct
aggctccttacaggcagcccg

SEQ ID NO: 5063 - DNA, 21 bp, Artificial Sequence
  Synthetic construct
ggctccttacaggcagcccga

SEQ ID NO: 5064 - DNA, 21 bp, Artificial Sequence
  Synthetic construct
gctccttacaggcagcccgat

SEQ ID NO: 5065 - DNA, 21 bp, Artificial Sequence
  Synthetic construct
ctccttacaggcagcccgatc

SEQ ID NO: 5066 - DNA, 21 bp, Artificial Sequence
  Synthetic construct
tccttacaggcagcccgatct

SEQ ID NO: 5067 - DNA, 21 bp, Artificial Sequence
  Synthetic construct
ccttacaggcagcccgatcta

SEQ ID NO: 5068 - DNA, 21 bp, Artificial Sequence
  Synthetic construct
cttacaggcagcccgatctat

SEQ ID NO: 5069 - DNA, 21 bp, Artificial Sequence
  Synthetic construct
ttacaggcagcccgatctatt

SEQ ID NO: 5070 - DNA, 21 bp, Artificial Sequence
  Synthetic construct
tacaggcagcccgatctattt

SEQ ID NO: 5071 - DNA, 21 bp, Artificial Sequence
  Synthetic construct
acaggcagcccgatctatttt

SEQ ID NO: 5072 - DNA, 21 bp, Artificial Sequence
  Synthetic construct
caggcagcccgatctatttta

SEQ ID NO: 5073 - DNA, 21 bp, Artificial Sequence
  Synthetic construct
aggcagcccgatctattttat

SEQ ID NO: 5074 - DNA, 21 bp, Artificial Sequence
  Synthetic construct
ggcagcccgatctattttatt

SEQ ID NO: 5075 - DNA, 21 bp, Artificial Sequence
  Synthetic construct
gcagcccgatctattttatta

SEQ ID NO: 5076 - DNA, 21 bp, Artificial Sequence
  Synthetic construct
cagcccgatctattttattat

SEQ ID NO: 5077 - DNA, 21 bp, Artificial Sequence
  Synthetic construct
agcccgatctattttattatt

SEQ ID NO: 5078 - DNA, 21 bp, Artificial Sequence
  Synthetic construct
gcccgatctattttattattc

SEQ ID NO: 5079 - DNA, 21 bp, Artificial Sequence
  Synthetic construct
cccgatctattttattattct

SEQ ID NO: 5080 - DNA, 21 bp, Artificial Sequence
  Synthetic construct
ccgatctattttattattctt

SEQ ID NO: 5081 - DNA, 21 bp, Artificial Sequence
  Synthetic construct
cgatctattttattattcttc

SEQ ID NO: 5082 - DNA, 21 bp, Artificial Sequence
  Synthetic construct
gatctattttattattcttcg

SEQ ID NO: 5083 - DNA, 21 bp, Artificial Sequence
  Synthetic construct
atctattttattattcttcgg

SEQ ID NO: 5084 - DNA, 21 bp, Artificial Sequence
  Synthetic construct
tctattttattattcttcgga

SEQ ID NO: 5085 - DNA, 21 bp, Artificial Sequence
  Synthetic construct
ctattttattattcttcggaa

SEQ ID NO: 5086 - DNA, 21 bp, Artificial Sequence
  Synthetic construct
tattttattattcttcggaac

SEQ ID NO: 5087 - DNA, 21 bp, Artificial Sequence
  Synthetic construct
attttattattcttcggaact

SEQ ID NO: 5088 - DNA, 21 bp, Artificial Sequence
  Synthetic construct
ttttattattcttcggaactg

SEQ ID NO: 5089 - DNA, 21 bp, Artificial Sequence
  Synthetic construct
tttattattcttcggaactgt

SEQ ID NO: 5090 - DNA, 21 bp, Artificial Sequence
  Synthetic construct
ttattattcttcggaactgta

SEQ ID NO: 5091 - DNA, 21 bp, Artificial Sequence
  Synthetic construct
tattattcttcggaactgtaa

SEQ ID NO: 5092 - DNA, 21 bp, Artificial Sequence
  Synthetic construct
attattcttcggaactgtaaa

SEQ ID NO: 5093 - DNA, 21 bp, Artificial Sequence
  Synthetic construct
ttattcttcggaactgtaaac

SEQ ID NO: 5094 - DNA, 21 bp, Artificial Sequence
  Synthetic construct
tattcttcggaactgtaaaca

SEQ ID NO: 5095 - DNA, 21 bp, Artificial Sequence
  Synthetic construct
attcttcggaactgtaaacac

SEQ ID NO: 5096 - DNA, 21 bp, Artificial Sequence
  Synthetic construct
ttcttcggaactgtaaacact

SEQ ID NO: 5097 - DNA, 21 bp, Artificial Sequence
  Synthetic construct
tcttcggaactgtaaacactc

SEQ ID NO: 5098 - DNA, 21 bp, Artificial Sequence
  Synthetic construct
cttcggaactgtaaacactcc

SEQ ID NO: 5099 - DNA, 21 bp, Artificial Sequence
  Synthetic construct
ttcggaactgtaaacactccg

SEQ ID NO: 5100 - DNA, 21 bp, Artificial Sequence
  Synthetic construct
tcggaactgtaaacactccgt

SEQ ID NO: 5101 - DNA, 21 bp, Artificial Sequence
  Synthetic construct
cggaactgtaaacactccgtt

SEQ ID NO: 5102 - DNA, 21 bp, Artificial Sequence
  Synthetic construct
ggaactgtaaacactccgttc

SEQ ID NO: 5103 - DNA, 21 bp, Artificial Sequence
  Synthetic construct
gaactgtaaacactccgttcc

SEQ ID NO: 5104 - DNA, 21 bp, Artificial Sequence
  Synthetic construct
aactgtaaacactccgttccc

SEQ ID NO: 5105 - DNA, 21 bp, Artificial Sequence
  Synthetic construct
actgtaaacactccgttccct

SEQ ID NO: 5106 - DNA, 21 bp, Artificial Sequence
  Synthetic construct
ctgtaaacactccgttcccta

SEQ ID NO: 5107 - DNA, 21 bp, Artificial Sequence
  Synthetic construct
tgtaaacactccgttccctac

SEQ ID NO: 5108 - DNA, 21 bp, Artificial Sequence
  Synthetic construct
gtaaacactccgttccctaca

SEQ ID NO: 5109 - DNA, 21 bp, Artificial Sequence
  Synthetic construct
taaacactccgttccctacaa

SEQ ID NO: 5110 - DNA, 21 bp, Artificial Sequence
  Synthetic construct
aaacactccgttccctacaac

SEQ ID NO: 5111 - DNA, 21 bp, Artificial Sequence
  Synthetic construct
aacactccgttccctacaacg

SEQ ID NO: 5112 - DNA, 21 bp, Artificial Sequence
  Synthetic construct
acactccgttccctacaacga

SEQ ID NO: 5113 - DNA, 21 bp, Artificial Sequence
  Synthetic construct
cactccgttccctacaacgag

SEQ ID NO: 5114 - DNA, 21 bp, Artificial Sequence
  Synthetic construct
actccgttccctacaacgagc

SEQ ID NO: 5115 - DNA, 21 bp, Artificial Sequence
  Synthetic construct
ctccgttccctacaacgagcc

SEQ ID NO: 5116 - DNA, 21 bp, Artificial Sequence
  Synthetic construct
tccgttccctacaacgagcct

SEQ ID NO: 5117 - DNA, 21 bp, Artificial Sequence
  Synthetic construct
ccgttccctacaacgagccta

SEQ ID NO: 5118 - DNA, 21 bp, Artificial Sequence
  Synthetic construct
cgttccctacaacgagcctaa

SEQ ID NO: 5119 - DNA, 21 bp, Artificial Sequence
  Synthetic construct
gttccctacaacgagcctaaa

SEQ ID NO: 5120 - DNA, 21 bp, Artificial Sequence
  Synthetic construct
ttccctacaacgagcctaaat

SEQ ID NO: 5121 - DNA, 21 bp, Artificial Sequence
  Synthetic construct
tccctacaacgagcctaaatt

SEQ ID NO: 5122 - DNA, 21 bp, Artificial Sequence
  Synthetic construct
ccctacaacgagcctaaattc

SEQ ID NO: 5123 - DNA, 21 bp, Artificial Sequence
  Synthetic construct
cctacaacgagcctaaattca

SEQ ID NO: 5124 - DNA, 21 bp, Artificial Sequence
  Synthetic construct
ctacaacgagcctaaattcat

SEQ ID NO: 5125 - DNA, 21 bp, Artificial Sequence
  Synthetic construct
tacaacgagcctaaattcata

SEQ ID NO: 5126 - DNA, 21 bp, Artificial Sequence
  Synthetic construct
acaacgagcctaaattcatat

SEQ ID NO: 5127 - DNA, 21 bp, Artificial Sequence
  Synthetic construct
caacgagcctaaattcatatg

SEQ ID NO: 5128 - DNA, 21 bp, Artificial Sequence
  Synthetic construct
aacgagcctaaattcatatga

SEQ ID NO: 5129 - DNA, 21 bp, Artificial Sequence
  Synthetic construct
acgagcctaaattcatatgac

SEQ ID NO: 5130 - DNA, 21 bp, Artificial Sequence
  Synthetic construct
cgagcctaaattcatatgact

SEQ ID NO: 5131 - DNA, 21 bp, Artificial Sequence
  Synthetic construct
gagcctaaattcatatgactc

SEQ ID NO: 5132 - DNA, 21 bp, Artificial Sequence
  Synthetic construct
agcctaaattcatatgactcg

SEQ ID NO: 5133 - DNA, 21 bp, Artificial Sequence
  Synthetic construct
gcctaaattcatatgactcgt

SEQ ID NO: 5134 - DNA, 21 bp, Artificial Sequence
  Synthetic construct
cctaaattcatatgactcgtt

SEQ ID NO: 5135 - DNA, 21 bp, Artificial Sequence
  Synthetic construct
ctaaattcatatgactcgtta

SEQ ID NO: 5136 - DNA, 21 bp, Artificial Sequence
  Synthetic construct
taaattcatatgactcgttat

SEQ ID NO: 5137 - DNA, 21 bp, Artificial Sequence
  Synthetic construct
aaattcatatgactcgttata

SEQ ID NO: 5138 - DNA, 21 bp, Artificial Sequence
  Synthetic construct
aattcatatgactcgttatag

SEQ ID NO: 5139 - DNA, 21 bp, Artificial Sequence
  Synthetic construct
attcatatgactcgttatagc

SEQ ID NO: 5140 - DNA, 21 bp, Artificial Sequence
  Synthetic construct
ttcatatgactcgttatagcg

SEQ ID NO: 5141 - DNA, 21 bp, Artificial Sequence
  Synthetic construct
tcatatgactcgttatagcgg

SEQ ID NO: 5142 - DNA, 21 bp, Artificial Sequence
  Synthetic construct
catatgactcgttatagcgga

SEQ ID NO: 5143 - DNA, 21 bp, Artificial Sequence
  Synthetic construct
atatgactcgttatagcggac

SEQ ID NO: 5144 - DNA, 21 bp, Artificial Sequence
  Synthetic construct
tatgactcgttatagcggacc

SEQ ID NO: 5145 - DNA, 21 bp, Artificial Sequence
  Synthetic construct
atgactcgttatagcggaccg

SEQ ID NO: 5146 - DNA, 21 bp, Artificial Sequence
  Synthetic construct
tgactcgttatagcggaccgc

SEQ ID NO: 5147 - DNA, 21 bp, Artificial Sequence
  Synthetic construct
gactcgttatagcggaccgcg

SEQ ID NO: 5148 - DNA, 21 bp, Artificial Sequence
  Synthetic construct
actcgttatagcggaccgcgt

SEQ ID NO: 5149 - DNA, 21 bp, Artificial Sequence
  Synthetic construct
ctcgttatagcggaccgcgtg

SEQ ID NO: 5150 - DNA, 21 bp, Artificial Sequence
  Synthetic construct
tcgttatagcggaccgcgtgt

SEQ ID NO: 5151 - DNA, 21 bp, Artificial Sequence
  Synthetic construct
cgttatagcggaccgcgtgtc

SEQ ID NO: 5152 - DNA, 21 bp, Artificial Sequence
  Synthetic construct
gttatagcggaccgcgtgtct

SEQ ID NO: 5153 - DNA, 21 bp, Artificial Sequence
  Synthetic construct
ttatagcggaccgcgtgtctg

SEQ ID NO: 5154 - DNA, 21 bp, Artificial Sequence
  Synthetic construct
tatagcggaccgcgtgtctga

SEQ ID NO: 5155 - DNA, 21 bp, Artificial Sequence
  Synthetic construct
atagcggaccgcgtgtctgat

SEQ ID NO: 5156 - DNA, 21 bp, Artificial Sequence
  Synthetic construct
tagcggaccgcgtgtctgatc

SEQ ID NO: 5157 - DNA, 21 bp, Artificial Sequence
  Synthetic construct
agcggaccgcgtgtctgatcc

SEQ ID NO: 5158 - DNA, 21 bp, Artificial Sequence
  Synthetic construct
gcggaccgcgtgtctgatcca

SEQ ID NO: 5159 - DNA, 21 bp, Artificial Sequence
  Synthetic construct
cggaccgcgtgtctgatccac

SEQ ID NO: 5160 - DNA, 21 bp, Artificial Sequence
  Synthetic construct
ggaccgcgtgtctgatccacg

SEQ ID NO: 5161 - DNA, 21 bp, Artificial Sequence
  Synthetic construct
gaccgcgtgtctgatccacgg

SEQ ID NO: 5162 - DNA, 21 bp, Artificial Sequence
  Synthetic construct
accgcgtgtctgatccacggc

SEQ ID NO: 5163 - DNA, 21 bp, Artificial Sequence
  Synthetic construct
ccgcgtgtctgatccacggcg

SEQ ID NO: 5164 - DNA, 21 bp, Artificial Sequence
  Synthetic construct
cgcgtgtctgatccacggcgc

SEQ ID NO: 5165 - DNA, 21 bp, Artificial Sequence
  Synthetic construct
gcgtgtctgatccacggcgca

SEQ ID NO: 5166 - DNA, 21 bp, Artificial Sequence
  Synthetic construct
cgtgtctgatccacggcgcac

SEQ ID NO: 5167 - DNA, 21 bp, Artificial Sequence
  Synthetic construct
gtgtctgatccacggcgcaca

SEQ ID NO: 5168 - DNA, 21 bp, Artificial Sequence
  Synthetic construct
tgtctgatccacggcgcacat

SEQ ID NO: 5169 - DNA, 21 bp, Artificial Sequence
  Synthetic construct
gtctgatccacggcgcacatt

SEQ ID NO: 5170 - DNA, 21 bp, Artificial Sequence
  Synthetic construct
tctgatccacggcgcacattg

SEQ ID NO: 5171 - DNA, 21 bp, Artificial Sequence
  Synthetic construct
ctgatccacggcgcacattgg

SEQ ID NO: 5172 - DNA, 21 bp, Artificial Sequence
  Synthetic construct
tgatccacggcgcacattggt

SEQ ID NO: 5173 - DNA, 21 bp, Artificial Sequence
  Synthetic construct
gatccacggcgcacattggtc

SEQ ID NO: 5174 - DNA, 21 bp, Artificial Sequence
  Synthetic construct
atccacggcgcacattggtct

SEQ ID NO: 5175 - DNA, 21 bp, Artificial Sequence
  Synthetic construct
tccacggcgcacattggtctc

SEQ ID NO: 5176 - DNA, 21 bp, Artificial Sequence
  Synthetic construct
ccacggcgcacattggtctcg

SEQ ID NO: 5177 - DNA, 21 bp, Artificial Sequence
  Synthetic construct
cacggcgcacattggtctcgg

SEQ ID NO: 5178 - DNA, 21 bp, Artificial Sequence
  Synthetic construct
acggcgcacattggtctcgga

SEQ ID NO: 5179 - DNA, 21 bp, Artificial Sequence
  Synthetic construct
cggcgcacattggtctcggac

SEQ ID NO: 5180 - DNA, 21 bp, Artificial Sequence
  Synthetic construct
ggcgcacattggtctcggacc

SEQ ID NO: 5181 - DNA, 21 bp, Artificial Sequence
  Synthetic construct
gcgcacattggtctcggacca

SEQ ID NO: 5182 - DNA, 21 bp, Artificial Sequence
  Synthetic construct
cgcacattggtctcggaccaa

SEQ ID NO: 5183 - DNA, 21 bp, Artificial Sequence
  Synthetic construct
gcacattggtctcggaccaat

SEQ ID NO: 5184 - DNA, 21 bp, Artificial Sequence
  Synthetic construct
cacattggtctcggaccaata

SEQ ID NO: 5185 - DNA, 21 bp, Artificial Sequence
  Synthetic construct
acattggtctcggaccaatag

SEQ ID NO: 5186 - DNA, 21 bp, Artificial Sequence
  Synthetic construct
cattggtctcggaccaataga

SEQ ID NO: 5187 - DNA, 21 bp, Artificial Sequence
  Synthetic construct
attggtctcggaccaatagag

SEQ ID NO: 5188 - DNA, 21 bp, Artificial Sequence
  Synthetic construct
ttggtctcggaccaatagagc

SEQ ID NO: 5189 - DNA, 21 bp, Artificial Sequence
  Synthetic construct
tggtctcggaccaatagagcc

SEQ ID NO: 5190 - DNA, 21 bp, Artificial Sequence
  Synthetic construct
ggtctcggaccaatagagccg

SEQ ID NO: 5191 - DNA, 21 bp, Artificial Sequence
  Synthetic construct
gtctcggaccaatagagccgc

SEQ ID NO: 5192 - DNA, 21 bp, Artificial Sequence
  Synthetic construct
tctcggaccaatagagccgct

SEQ ID NO: 5193 - DNA, 21 bp, Artificial Sequence
  Synthetic construct
ctcggaccaatagagccgctc

SEQ ID NO: 5194 - DNA, 21 bp, Artificial Sequence
  Synthetic construct
tcggaccaatagagccgctct

SEQ ID NO: 5195 - DNA, 21 bp, Artificial Sequence
  Synthetic construct
cggaccaatagagccgctctc

SEQ ID NO: 5196 - DNA, 21 bp, Artificial Sequence
  Synthetic construct
ggaccaatagagccgctctca

SEQ ID NO: 5197 - DNA, 21 bp, Artificial Sequence
  Synthetic construct
gaccaatagagccgctctcag

SEQ ID NO: 5198 - DNA, 21 bp, Artificial Sequence
  Synthetic construct
accaatagagccgctctcaga

SEQ ID NO: 5199 - DNA, 21 bp, Artificial Sequence
  Synthetic construct
ccaatagagccgctctcagag

SEQ ID NO: 5200 - DNA, 21 bp, Artificial Sequence
  Synthetic construct
caatagagccgctctcagagc

SEQ ID NO: 5201 - DNA, 21 bp, Artificial Sequence
  Synthetic construct
aatagagccgctctcagagcg

SEQ ID NO: 5202 - DNA, 21 bp, Artificial Sequence
  Synthetic construct
atagagccgctctcagagcgc

SEQ ID NO: 5203 - DNA, 21 bp, Artificial Sequence
  Synthetic construct
tagagccgctctcagagcgcg

SEQ ID NO: 5204 - DNA, 21 bp, Artificial Sequence
  Synthetic construct
agagccgctctcagagcgcgg

SEQ ID NO: 5205 - DNA, 21 bp, Artificial Sequence
  Synthetic construct
gagccgctctcagagcgcggg

SEQ ID NO: 5206 - DNA, 21 bp, Artificial Sequence
  Synthetic construct
agccgctctcagagcgcgggg

SEQ ID NO: 5207 - DNA, 21 bp, Artificial Sequence
  Synthetic construct
gccgctctcagagcgcggggg

SEQ ID NO: 5208 - DNA, 21 bp, Artificial Sequence
  Synthetic construct
ccgctctcagagcgcgggggg

SEQ ID NO: 5209 - DNA, 21 bp, Artificial Sequence
  Synthetic construct
cgctctcagagcgcggggggt

SEQ ID NO: 5210 - DNA, 21 bp, Artificial Sequence
  Synthetic construct
gctctcagagcgcggggggta

SEQ ID NO: 5211 - DNA, 21 bp, Artificial Sequence
  Synthetic construct
ctctcagagcgcggggggtaa

SEQ ID NO: 5212 - DNA, 21 bp, Artificial Sequence
  Synthetic construct
tctcagagcgcggggggtaac

SEQ ID NO: 5213 - DNA, 21 bp, Artificial Sequence
  Synthetic construct
ctcagagcgcggggggtaacg

SEQ ID NO: 5214 - DNA, 21 bp, Artificial Sequence
  Synthetic construct
tcagagcgcggggggtaacgg

SEQ ID NO: 5215 - DNA, 21 bp, Artificial Sequence
  Synthetic construct
cagagcgcggggggtaacggt

SEQ ID NO: 5216 - DNA, 21 bp, Artificial Sequence
  Synthetic construct
agagcgcggggggtaacggtt

SEQ ID NO: 5217 - DNA, 21 bp, Artificial Sequence
  Synthetic construct
gagcgcggggggtaacggttg

SEQ ID NO: 5218 - DNA, 21 bp, Artificial Sequence
  Synthetic construct
agcgcggggggtaacggttgc

SEQ ID NO: 5219 - DNA, 21 bp, Artificial Sequence
  Synthetic construct
gcgcggggggtaacggttgct

SEQ ID NO: 5220 - DNA, 21 bp, Artificial Sequence
  Synthetic construct
cgcggggggtaacggttgctt

SEQ ID NO: 5221 - DNA, 21 bp, Artificial Sequence
  Synthetic construct
gcggggggtaacggttgcttg

SEQ ID NO: 5222 - DNA, 21 bp, Artificial Sequence
  Synthetic construct
cggggggtaacggttgcttgt

SEQ ID NO: 5223 - DNA, 21 bp, Artificial Sequence
  Synthetic construct
ggggggtaacggttgcttgtt

SEQ ID NO: 5224 - DNA, 21 bp, Artificial Sequence
  Synthetic construct
gggggtaacggttgcttgttc

SEQ ID NO: 5225 - DNA, 21 bp, Artificial Sequence
  Synthetic construct
ggggtaacggttgcttgttca

SEQ ID NO: 5226 - DNA, 21 bp, Artificial Sequence
  Synthetic construct
gggtaacggttgcttgttcag

SEQ ID NO: 5227 - DNA, 21 bp, Artificial Sequence
  Synthetic construct
ggtaacggttgcttgttcagc

SEQ ID NO: 5228 - DNA, 21 bp, Artificial Sequence
  Synthetic construct
gtaacggttgcttgttcagcg

SEQ ID NO: 5229 - DNA, 21 bp, Artificial Sequence
  Synthetic construct
taacggttgcttgttcagcga

SEQ ID NO: 5230 - DNA, 21 bp, Artificial Sequence
  Synthetic construct
aacggttgcttgttcagcgaa

SEQ ID NO: 5231 - DNA, 21 bp, Artificial Sequence
  Synthetic construct
acggttgcttgttcagcgaac

SEQ ID NO: 5232 - DNA, 21 bp, Artificial Sequence
  Synthetic construct
cggttgcttgttcagcgaact

SEQ ID NO: 5233 - DNA, 21 bp, Artificial Sequence
  Synthetic construct
ggttgcttgttcagcgaactt

SEQ ID NO: 5234 - DNA, 21 bp, Artificial Sequence
  Synthetic construct
gttgcttgttcagcgaacttc

SEQ ID NO: 5235 - DNA, 21 bp, Artificial Sequence
  Synthetic construct
ttgcttgttcagcgaacttct

SEQ ID NO: 5236 - DNA, 21 bp, Artificial Sequence
  Synthetic construct
tgcttgttcagcgaacttctt

SEQ ID NO: 5237 - DNA, 21 bp, Artificial Sequence
  Synthetic construct
gcttgttcagcgaacttcttg

SEQ ID NO: 5238 - DNA, 21 bp, Artificial Sequence
  Synthetic construct
cttgttcagcgaacttcttgt

SEQ ID NO: 5239 - DNA, 21 bp, Artificial Sequence
  Synthetic construct
ttgttcagcgaacttcttgta

SEQ ID NO: 5240 - DNA, 21 bp, Artificial Sequence
  Synthetic construct
tgttcagcgaacttcttgtaa

SEQ ID NO: 5241 - DNA, 21 bp, Artificial Sequence
  Synthetic construct
gttcagcgaacttcttgtaag

SEQ ID NO: 5242 - DNA, 21 bp, Artificial Sequence
  Synthetic construct
ttcagcgaacttcttgtaagg

SEQ ID NO: 5243 - DNA, 21 bp, Artificial Sequence
  Synthetic construct
tcagcgaacttcttgtaaggc

SEQ ID NO: 5244 - DNA, 21 bp, Artificial Sequence
  Synthetic construct
cagcgaacttcttgtaaggcg

SEQ ID NO: 5245 - DNA, 21 bp, Artificial Sequence
  Synthetic construct
agcgaacttcttgtaaggcgc

SEQ ID NO: 5246 - DNA, 21 bp, Artificial Sequence
  Synthetic construct
gcgaacttcttgtaaggcgct

SEQ ID NO: 5247 - DNA, 21 bp, Artificial Sequence
  Synthetic construct
cgaacttcttgtaaggcgctg

SEQ ID NO: 5248 - DNA, 21 bp, Artificial Sequence
  Synthetic construct
gaacttcttgtaaggcgctgc

SEQ ID NO: 5249 - DNA, 21 bp, Artificial Sequence
  Synthetic construct
aacttcttgtaaggcgctgca

SEQ ID NO: 5250 - DNA, 21 bp, Artificial Sequence
  Synthetic construct
acttcttgtaaggcgctgcat

SEQ ID NO: 5251 - DNA, 21 bp, Artificial Sequence
  Synthetic construct
cttcttgtaaggcgctgcatc

SEQ ID NO: 5252 - DNA, 21 bp, Artificial Sequence
  Synthetic construct
ttcttgtaaggcgctgcatcc

SEQ ID NO: 5253 - DNA, 21 bp, Artificial Sequence
  Synthetic construct
tcttgtaaggcgctgcatcct

SEQ ID NO: 5254 - DNA, 21 bp, Artificial Sequence
  Synthetic construct
cttgtaaggcgctgcatcctg

SEQ ID NO: 5255 - DNA, 21 bp, Artificial Sequence
  Synthetic construct
ttgtaaggcgctgcatcctgc

SEQ ID NO: 5256 - DNA, 21 bp, Artificial Sequence
  Synthetic construct
tgtaaggcgctgcatcctgca

SEQ ID NO: 5257 - DNA, 21 bp, Artificial Sequence
  Synthetic construct
gtaaggcgctgcatcctgcaa

SEQ ID NO: 5258 - DNA, 21 bp, Artificial Sequence
  Synthetic construct
taaggcgctgcatcctgcaac

SEQ ID NO: 5259 - DNA, 21 bp, Artificial Sequence
  Synthetic construct
aaggcgctgcatcctgcaact

SEQ ID NO: 5260 - DNA, 21 bp, Artificial Sequence
  Synthetic construct
aggcgctgcatcctgcaactt

SEQ ID NO: 5261 - DNA, 21 bp, Artificial Sequence
  Synthetic construct
ggcgctgcatcctgcaacttg

SEQ ID NO: 5262 - DNA, 21 bp, Artificial Sequence
  Synthetic construct
gcgctgcatcctgcaacttgt

SEQ ID NO: 5263 - DNA, 21 bp, Artificial Sequence
  Synthetic construct
cgctgcatcctgcaacttgtg

SEQ ID NO: 5264 - DNA, 21 bp, Artificial Sequence
  Synthetic construct
gctgcatcctgcaacttgtgc

SEQ ID NO: 5265 - DNA, 21 bp, Artificial Sequence
  Synthetic construct
ctgcatcctgcaacttgtgcc

SEQ ID NO: 5266 - DNA, 21 bp, Artificial Sequence
  Synthetic construct
tgcatcctgcaacttgtgccc

SEQ ID NO: 5267 - DNA, 21 bp, Artificial Sequence
  Synthetic construct
gcatcctgcaacttgtgcccc

SEQ ID NO: 5268 - DNA, 21 bp, Artificial Sequence
  Synthetic construct
catcctgcaacttgtgcccca

SEQ ID NO: 5269 - DNA, 21 bp, Artificial Sequence
  Synthetic construct
atcctgcaacttgtgccccat

SEQ ID NO: 5270 - DNA, 21 bp, Artificial Sequence
  Synthetic construct
tcctgcaacttgtgccccata

SEQ ID NO: 5271 - DNA, 21 bp, Artificial Sequence
  Synthetic construct
cctgcaacttgtgccccatag

SEQ ID NO: 5272 - DNA, 21 bp, Artificial Sequence
  Synthetic construct
ctgcaacttgtgccccatagg

SEQ ID NO: 5273 - DNA, 21 bp, Artificial Sequence
  Synthetic construct
tgcaacttgtgccccatagga

SEQ ID NO: 5274 - DNA, 21 bp, Artificial Sequence
  Synthetic construct
gcaacttgtgccccataggag

SEQ ID NO: 5275 - DNA, 21 bp, Artificial Sequence
  Synthetic construct
caacttgtgccccataggagc

SEQ ID NO: 5276 - DNA, 21 bp, Artificial Sequence
  Synthetic construct
aacttgtgccccataggagca

SEQ ID NO: 5277 - DNA, 21 bp, Artificial Sequence
  Synthetic construct
acttgtgccccataggagcac

SEQ ID NO: 5278 - DNA, 21 bp, Artificial Sequence
  Synthetic construct
cttgtgccccataggagcacc

SEQ ID NO: 5279 - DNA, 21 bp, Artificial Sequence
  Synthetic construct
ttgtgccccataggagcaccg

SEQ ID NO: 5280 - DNA, 21 bp, Artificial Sequence
  Synthetic construct
tgtgccccataggagcaccgt

SEQ ID NO: 5281 - DNA, 21 bp, Artificial Sequence
  Synthetic construct
gtgccccataggagcaccgtt

SEQ ID NO: 5282 - DNA, 21 bp, Artificial Sequence
  Synthetic construct
tgccccataggagcaccgttg

SEQ ID NO: 5283 - DNA, 21 bp, Artificial Sequence
  Synthetic construct
gccccataggagcaccgttgg

SEQ ID NO: 5284 - DNA, 21 bp, Artificial Sequence
  Synthetic construct
ccccataggagcaccgttgga

SEQ ID NO: 5285 - DNA, 21 bp, Artificial Sequence
  Synthetic construct
cccataggagcaccgttggag

SEQ ID NO: 5286 - DNA, 21 bp, Artificial Sequence
  Synthetic construct
ccataggagcaccgttggaga

SEQ ID NO: 5287 - DNA, 21 bp, Artificial Sequence
  Synthetic construct
cataggagcaccgttggagaa

SEQ ID NO: 5288 - DNA, 21 bp, Artificial Sequence
  Synthetic construct
ataggagcaccgttggagaac

SEQ ID NO: 5289 - DNA, 21 bp, Artificial Sequence
  Synthetic construct
taggagcaccgttggagaacg

SEQ ID NO: 5290 - DNA, 21 bp, Artificial Sequence
  Synthetic construct
aggagcaccgttggagaacgt

SEQ ID NO: 5291 - DNA, 21 bp, Artificial Sequence
  Synthetic construct
ggagcaccgttggagaacgtg

SEQ ID NO: 5292 - DNA, 21 bp, Artificial Sequence
  Synthetic construct
gagcaccgttggagaacgtgc

SEQ ID NO: 5293 - DNA, 21 bp, Artificial Sequence
  Synthetic construct
agcaccgttggagaacgtgca

SEQ ID NO: 5294 - DNA, 21 bp, Artificial Sequence
  Synthetic construct
gcaccgttggagaacgtgcat

SEQ ID NO: 5295 - DNA, 21 bp, Artificial Sequence
  Synthetic construct
caccgttggagaacgtgcatt

SEQ ID NO: 5296 - DNA, 21 bp, Artificial Sequence
  Synthetic construct
accgttggagaacgtgcattg

SEQ ID NO: 5297 - DNA, 21 bp, Artificial Sequence
  Synthetic construct
ccgttggagaacgtgcattgc

SEQ ID NO: 5298 - DNA, 21 bp, Artificial Sequence
  Synthetic construct
cgttggagaacgtgcattgcc

SEQ ID NO: 5299 - DNA, 21 bp, Artificial Sequence
  Synthetic construct
gttggagaacgtgcattgccc

SEQ ID NO: 5300 - DNA, 21 bp, Artificial Sequence
  Synthetic construct
ttggagaacgtgcattgccca

SEQ ID NO: 5301 - DNA, 21 bp, Artificial Sequence
  Synthetic construct
tggagaacgtgcattgcccaa

SEQ ID NO: 5302 - DNA, 21 bp, Artificial Sequence
  Synthetic construct
ggagaacgtgcattgcccaaa

SEQ ID NO: 5303 - DNA, 21 bp, Artificial Sequence
  Synthetic construct
gagaacgtgcattgcccaaac

SEQ ID NO: 5304 - DNA, 21 bp, Artificial Sequence
  Synthetic construct
agaacgtgcattgcccaaaca

SEQ ID NO: 5305 - DNA, 21 bp, Artificial Sequence
  Synthetic construct
gaacgtgcattgcccaaacaa

SEQ ID NO: 5306 - DNA, 21 bp, Artificial Sequence
  Synthetic construct
aacgtgcattgcccaaacaac

SEQ ID NO: 5307 - DNA, 21 bp, Artificial Sequence
  Synthetic construct
acgtgcattgcccaaacaacg

SEQ ID NO: 5308 - DNA, 21 bp, Artificial Sequence
  Synthetic construct
cgtgcattgcccaaacaacga

SEQ ID NO: 5309 - DNA, 21 bp, Artificial Sequence
  Synthetic construct
gtgcattgcccaaacaacgac

SEQ ID NO: 5310 - DNA, 21 bp, Artificial Sequence
  Synthetic construct
tgcattgcccaaacaacgacg

SEQ ID NO: 5311 - DNA, 21 bp, Artificial Sequence
  Synthetic construct
gcattgcccaaacaacgacga

SEQ ID NO: 5312 - DNA, 21 bp, Artificial Sequence
  Synthetic construct
cattgcccaaacaacgacgat

SEQ ID NO: 5313 - DNA, 21 bp, Artificial Sequence
  Synthetic construct
attgcccaaacaacgacgatc

SEQ ID NO: 5314 - DNA, 21 bp, Artificial Sequence
  Synthetic construct
ttgcccaaacaacgacgatcg

SEQ ID NO: 5315 - DNA, 21 bp, Artificial Sequence
  Synthetic construct
tgcccaaacaacgacgatcgg

SEQ ID NO: 5316 - DNA, 21 bp, Artificial Sequence
  Synthetic construct
gcccaaacaacgacgatcggt

SEQ ID NO: 5317 - DNA, 21 bp, Artificial Sequence
  Synthetic construct
cccaaacaacgacgatcggta

SEQ ID NO: 5318 - DNA, 21 bp, Artificial Sequence
  Synthetic construct
ccaaacaacgacgatcggtag

SEQ ID NO: 5319 - DNA, 21 bp, Artificial Sequence
  Synthetic construct
caaacaacgacgatcggtagc

SEQ ID NO: 5320 - DNA, 21 bp, Artificial Sequence
  Synthetic construct
aaacaacgacgatcggtagcc

SEQ ID NO: 5321 - DNA, 21 bp, Artificial Sequence
  Synthetic construct
aacaacgacgatcggtagcca

SEQ ID NO: 5322 - DNA, 21 bp, Artificial Sequence
  Synthetic construct
acaacgacgatcggtagccag

SEQ ID NO: 5323 - DNA, 21 bp, Artificial Sequence
  Synthetic construct
caacgacgatcggtagccaga

SEQ ID NO: 5324 - DNA, 21 bp, Artificial Sequence
  Synthetic construct
aacgacgatcggtagccagag

SEQ ID NO: 5325 - DNA, 21 bp, Artificial Sequence
  Synthetic construct
acgacgatcggtagccagaga

SEQ ID NO: 5326 - DNA, 21 bp, Artificial Sequence
  Synthetic construct
cgacgatcggtagccagagag

SEQ ID NO: 5327 - DNA, 21 bp, Artificial Sequence
  Synthetic construct
gacgatcggtagccagagagg

SEQ ID NO: 5328 - DNA, 21 bp, Artificial Sequence
  Synthetic construct
acgatcggtagccagagagga

SEQ ID NO: 5329 - DNA, 21 bp, Artificial Sequence
  Synthetic construct
cgatcggtagccagagaggag

SEQ ID NO: 5330 - DNA, 21 bp, Artificial Sequence
  Synthetic construct
gatcggtagccagagaggagg

SEQ ID NO: 5331 - DNA, 21 bp, Artificial Sequence
  Synthetic construct
atcggtagccagagaggaggt

SEQ ID NO: 5332 - DNA, 21 bp, Artificial Sequence
  Synthetic construct
tcggtagccagagaggaggtt

SEQ ID NO: 5333 - DNA, 21 bp, Artificial Sequence
  Synthetic construct
cggtagccagagaggaggttg

SEQ ID NO: 5334 - DNA, 21 bp, Artificial Sequence
  Synthetic construct
ggtagccagagaggaggttgc

SEQ ID NO: 5335 - DNA, 21 bp, Artificial Sequence
  Synthetic construct
gtagccagagaggaggttgcc

SEQ ID NO: 5336 - DNA, 21 bp, Artificial Sequence
  Synthetic construct
tagccagagaggaggttgcca

SEQ ID NO: 5337 - DNA, 21 bp, Artificial Sequence
  Synthetic construct
agccagagaggaggttgccaa

SEQ ID NO: 5338 - DNA, 21 bp, Artificial Sequence
  Synthetic construct
gccagagaggaggttgccaat

SEQ ID NO: 5339 - DNA, 21 bp, Artificial Sequence
  Synthetic construct
ccagagaggaggttgccaata

SEQ ID NO: 5340 - DNA, 21 bp, Artificial Sequence
  Synthetic construct
cagagaggaggttgccaataa

SEQ ID NO: 5341 - DNA, 21 bp, Artificial Sequence
  Synthetic construct
agagaggaggttgccaataag

SEQ ID NO: 5342 - DNA, 21 bp, Artificial Sequence
  Synthetic construct
gagaggaggttgccaataagg

SEQ ID NO: 5343 - DNA, 21 bp, Artificial Sequence
  Synthetic construct
agaggaggttgccaataaggc

SEQ ID NO: 5344 - DNA, 21 bp, Artificial Sequence
  Synthetic construct
gaggaggttgccaataaggct

SEQ ID NO: 5345 - DNA, 21 bp, Artificial Sequence
  Synthetic construct
aggaggttgccaataaggcta

SEQ ID NO: 5346 - DNA, 21 bp, Artificial Sequence
  Synthetic construct
ggaggttgccaataaggctac

SEQ ID NO: 5347 - DNA, 21 bp, Artificial Sequence
  Synthetic construct
gaggttgccaataaggctacg

SEQ ID NO: 5348 - DNA, 21 bp, Artificial Sequence
  Synthetic construct
aggttgccaataaggctacgg

SEQ ID NO: 5349 - DNA, 21 bp, Artificial Sequence
  Synthetic construct
ggttgccaataaggctacgga

SEQ ID NO: 5350 - DNA, 21 bp, Artificial Sequence
  Synthetic construct
gttgccaataaggctacggat

SEQ ID NO: 5351 - DNA, 21 bp, Artificial Sequence
  Synthetic construct
ttgccaataaggctacggatg

SEQ ID NO: 5352 - DNA, 21 bp, Artificial Sequence
  Synthetic construct
tgccaataaggctacggatgc

SEQ ID NO: 5353 - DNA, 21 bp, Artificial Sequence
  Synthetic construct
gccaataaggctacggatgct

SEQ ID NO: 5354 - DNA, 21 bp, Artificial Sequence
  Synthetic construct
ccaataaggctacggatgctg

SEQ ID NO: 5355 - DNA, 21 bp, Artificial Sequence
  Synthetic construct
caataaggctacggatgctgg

SEQ ID NO: 5356 - DNA, 21 bp, Artificial Sequence
  Synthetic construct
aataaggctacggatgctggt

SEQ ID NO: 5357 - DNA, 21 bp, Artificial Sequence
  Synthetic construct
ataaggctacggatgctggtt

SEQ ID NO: 5358 - DNA, 21 bp, Artificial Sequence
  Synthetic construct
taaggctacggatgctggttt

SEQ ID NO: 5359 - DNA, 21 bp, Artificial Sequence
  Synthetic construct
aaggctacggatgctggtttg

SEQ ID NO: 5360 - DNA, 21 bp, Artificial Sequence
  Synthetic construct
aggctacggatgctggtttgt

SEQ ID NO: 5361 - DNA, 21 bp, Artificial Sequence
  Synthetic construct
ggctacggatgctggtttgta

SEQ ID NO: 5362 - DNA, 21 bp, Artificial Sequence
  Synthetic construct
gctacggatgctggtttgtaa

SEQ ID NO: 5363 - DNA, 21 bp, Artificial Sequence
  Synthetic construct
ctacggatgctggtttgtaaa

SEQ ID NO: 5364 - DNA, 21 bp, Artificial Sequence
  Synthetic construct
tacggatgctggtttgtaaaa

SEQ ID NO: 5365 - DNA, 21 bp, Artificial Sequence
  Synthetic construct
acggatgctggtttgtaaaac

SEQ ID NO: 5366 - DNA, 21 bp, Artificial Sequence
  Synthetic construct
cggatgctggtttgtaaaaca

SEQ ID NO: 5367 - DNA, 21 bp, Artificial Sequence
  Synthetic construct
ggatgctggtttgtaaaacat

SEQ ID NO: 5368 - DNA, 21 bp, Artificial Sequence
  Synthetic construct
gatgctggtttgtaaaacatc

SEQ ID NO: 5369 - DNA, 21 bp, Artificial Sequence
  Synthetic construct
atgctggtttgtaaaacatcc

SEQ ID NO: 5370 - DNA, 21 bp, Artificial Sequence
  Synthetic construct
tgctggtttgtaaaacatccg

SEQ ID NO: 5371 - DNA, 21 bp, Artificial Sequence
  Synthetic construct
gctggtttgtaaaacatccgg

SEQ ID NO: 5372 - DNA, 21 bp, Artificial Sequence
  Synthetic construct
ctggtttgtaaaacatccgga

SEQ ID NO: 5373 - DNA, 21 bp, Artificial Sequence
  Synthetic construct
tggtttgtaaaacatccggat

SEQ ID NO: 5374 - DNA, 21 bp, Artificial Sequence
  Synthetic construct
ggtttgtaaaacatccggatc

SEQ ID NO: 5375 - DNA, 21 bp, Artificial Sequence
  Synthetic construct
gtttgtaaaacatccggatcc

SEQ ID NO: 5376 - DNA, 21 bp, Artificial Sequence
  Synthetic construct
tttgtaaaacatccggatccc

SEQ ID NO: 5377 - DNA, 21 bp, Artificial Sequence
  Synthetic construct
ttgtaaaacatccggatccca

SEQ ID NO: 5378 - DNA, 21 bp, Artificial Sequence
  Synthetic construct
tgtaaaacatccggatcccat

SEQ ID NO: 5379 - DNA, 21 bp, Artificial Sequence
  Synthetic construct
gtaaaacatccggatcccatg

SEQ ID NO: 5380 - DNA, 21 bp, Artificial Sequence
  Synthetic construct
taaaacatccggatcccatga

SEQ ID NO: 5381 - DNA, 21 bp, Artificial Sequence
  Synthetic construct
aaaacatccggatcccatgac

SEQ ID NO: 5382 - DNA, 21 bp, Artificial Sequence
  Synthetic construct
aaacatccggatcccatgaca

SEQ ID NO: 5383 - DNA, 21 bp, Artificial Sequence
  Synthetic construct
aacatccggatcccatgacaa

SEQ ID NO: 5384 - DNA, 21 bp, Artificial Sequence
  Synthetic construct
acatccggatcccatgacaag

SEQ ID NO: 5385 - DNA, 21 bp, Artificial Sequence
  Synthetic construct
catccggatcccatgacaagg

SEQ ID NO: 5386 - DNA, 21 bp, Artificial Sequence
  Synthetic construct
atccggatcccatgacaagga

SEQ ID NO: 5387 - DNA, 21 bp, Artificial Sequence
  Synthetic construct
tccggatcccatgacaaggat

SEQ ID NO: 5388 - DNA, 21 bp, Artificial Sequence
  Synthetic construct
ccggatcccatgacaaggatt

SEQ ID NO: 5389 - DNA, 21 bp, Artificial Sequence
  Synthetic construct
cggatcccatgacaaggattt

SEQ ID NO: 5390 - DNA, 21 bp, Artificial Sequence
  Synthetic construct
ggatcccatgacaaggatttg

SEQ ID NO: 5391 - DNA, 21 bp, Artificial Sequence
  Synthetic construct
gatcccatgacaaggatttgt

SEQ ID NO: 5392 - DNA, 21 bp, Artificial Sequence
  Synthetic construct
atcccatgacaaggatttgtc

SEQ ID NO: 5393 - DNA, 21 bp, Artificial Sequence
  Synthetic construct
tcccatgacaaggatttgtca

SEQ ID NO: 5394 - DNA, 21 bp, Artificial Sequence
  Synthetic construct
cccatgacaaggatttgtcat

SEQ ID NO: 5395 - DNA, 21 bp, Artificial Sequence
  Synthetic construct
ccatgacaaggatttgtcatg

SEQ ID NO: 5396 - DNA, 21 bp, Artificial Sequence
  Synthetic construct
catgacaaggatttgtcatgt

SEQ ID NO: 5397 - DNA, 21 bp, Artificial Sequence
  Synthetic construct
atgacaaggatttgtcatgta

SEQ ID NO: 5398 - DNA, 21 bp, Artificial Sequence
  Synthetic construct
tgacaaggatttgtcatgtaa

SEQ ID NO: 5399 - DNA, 21 bp, Artificial Sequence
  Synthetic construct
gacaaggatttgtcatgtaag

SEQ ID NO: 5400 - DNA, 21 bp, Artificial Sequence
  Synthetic construct
acaaggatttgtcatgtaaga

SEQ ID NO: 5401 - DNA, 21 bp, Artificial Sequence
  Synthetic construct
caaggatttgtcatgtaagaa

SEQ ID NO: 5402 - DNA, 21 bp, Artificial Sequence
  Synthetic construct
aaggatttgtcatgtaagaaa

SEQ ID NO: 5403 - DNA, 21 bp, Artificial Sequence
  Synthetic construct
aggatttgtcatgtaagaaac

SEQ ID NO: 5404 - DNA, 21 bp, Artificial Sequence
  Synthetic construct
ggatttgtcatgtaagaaacc

SEQ ID NO: 5405 - DNA, 21 bp, Artificial Sequence
  Synthetic construct
gatttgtcatgtaagaaacct

SEQ ID NO: 5406 - DNA, 21 bp, Artificial Sequence
  Synthetic construct
atttgtcatgtaagaaacctt

SEQ ID NO: 5407 - DNA, 21 bp, Artificial Sequence
  Synthetic construct
tttgtcatgtaagaaaccttc

SEQ ID NO: 5408 - DNA, 21 bp, Artificial Sequence
  Synthetic construct
ttgtcatgtaagaaaccttct

SEQ ID NO: 5409 - DNA, 21 bp, Artificial Sequence
  Synthetic construct
tgtcatgtaagaaaccttctc

SEQ ID NO: 5410 - DNA, 21 bp, Artificial Sequence
  Synthetic construct
gtcatgtaagaaaccttctct

SEQ ID NO: 5411 - DNA, 21 bp, Artificial Sequence
  Synthetic construct
tcatgtaagaaaccttctcta

SEQ ID NO: 5412 - DNA, 21 bp, Artificial Sequence
  Synthetic construct
catgtaagaaaccttctctat

SEQ ID NO: 5413 - DNA, 21 bp, Artificial Sequence
  Synthetic construct
atgtaagaaaccttctctatt

SEQ ID NO: 5414 - DNA, 21 bp, Artificial Sequence
  Synthetic construct
tgtaagaaaccttctctattt

SEQ ID NO: 5415 - DNA, 21 bp, Artificial Sequence
  Synthetic construct
gtaagaaaccttctctattta

SEQ ID NO: 5416 - DNA, 21 bp, Artificial Sequence
  Synthetic construct
taagaaaccttctctatttat

SEQ ID NO: 5417 - DNA, 21 bp, Artificial Sequence
  Synthetic construct
aagaaaccttctctatttatc

SEQ ID NO: 5418 - DNA, 21 bp, Artificial Sequence
  Synthetic construct
agaaaccttctctatttatct

SEQ ID NO: 5419 - DNA, 21 bp, Artificial Sequence
  Synthetic construct
gaaaccttctctatttatctg

SEQ ID NO: 5420 - DNA, 21 bp, Artificial Sequence
  Synthetic construct
aaaccttctctatttatctga

SEQ ID NO: 5421 - DNA, 21 bp, Artificial Sequence
  Synthetic construct
aaccttctctatttatctgac

SEQ ID NO: 5422 - DNA, 21 bp, Artificial Sequence
  Synthetic construct
accttctctatttatctgacc

SEQ ID NO: 5423 - DNA, 21 bp, Artificial Sequence
  Synthetic construct
ccttctctatttatctgaccg

SEQ ID NO: 5424 - DNA, 21 bp, Artificial Sequence
  Synthetic construct
cttctctatttatctgaccgc

SEQ ID NO: 5425 - DNA, 21 bp, Artificial Sequence
  Synthetic construct
ttctctatttatctgaccgcg

SEQ ID NO: 5426 - DNA, 21 bp, Artificial Sequence
  Synthetic construct
tctctatttatctgaccgcga

SEQ ID NO: 5427 - DNA, 21 bp, Artificial Sequence
  Synthetic construct
ctctatttatctgaccgcgat

SEQ ID NO: 5428 - DNA, 21 bp, Artificial Sequence
  Synthetic construct
tctatttatctgaccgcgatc

SEQ ID NO: 5429 - DNA, 21 bp, Artificial Sequence
  Synthetic construct
ctatttatctgaccgcgatca

SEQ ID NO: 5430 - DNA, 21 bp, Artificial Sequence
  Synthetic construct
tatttatctgaccgcgatcac

SEQ ID NO: 5431 - DNA, 21 bp, Artificial Sequence
  Synthetic construct
atttatctgaccgcgatcacc

SEQ ID NO: 5432 - DNA, 21 bp, Artificial Sequence
  Synthetic construct
tttatctgaccgcgatcacca

SEQ ID NO: 5433 - DNA, 21 bp, Artificial Sequence
  Synthetic construct
ttatctgaccgcgatcaccat

SEQ ID NO: 5434 - DNA, 21 bp, Artificial Sequence
  Synthetic construct
tatctgaccgcgatcaccatt

SEQ ID NO: 5435 - DNA, 21 bp, Artificial Sequence
  Synthetic construct
atctgaccgcgatcaccattc

SEQ ID NO: 5436 - DNA, 21 bp, Artificial Sequence
  Synthetic construct
tctgaccgcgatcaccattcg

SEQ ID NO: 5437 - DNA, 21 bp, Artificial Sequence
  Synthetic construct
ctgaccgcgatcaccattcgc

SEQ ID NO: 5438 - DNA, 21 bp, Artificial Sequence
  Synthetic construct
tgaccgcgatcaccattcgcc

SEQ ID NO: 5439 - DNA, 21 bp, Artificial Sequence
  Synthetic construct
gaccgcgatcaccattcgcct

SEQ ID NO: 5440 - DNA, 21 bp, Artificial Sequence
  Synthetic construct
accgcgatcaccattcgcctc

SEQ ID NO: 5441 - DNA, 21 bp, Artificial Sequence
  Synthetic construct
ccgcgatcaccattcgcctcc

SEQ ID NO: 5442 - DNA, 21 bp, Artificial Sequence
  Synthetic construct
cgcgatcaccattcgcctccc

SEQ ID NO: 5443 - DNA, 21 bp, Artificial Sequence
  Synthetic construct
gcgatcaccattcgcctcccg

SEQ ID NO: 5444 - DNA, 21 bp, Artificial Sequence
  Synthetic construct
cgatcaccattcgcctcccgt

SEQ ID NO: 5445 - DNA, 21 bp, Artificial Sequence
  Synthetic construct
gatcaccattcgcctcccgta

SEQ ID NO: 5446 - DNA, 21 bp, Artificial Sequence
  Synthetic construct
atcaccattcgcctcccgtag

SEQ ID NO: 5447 - DNA, 21 bp, Artificial Sequence
  Synthetic construct
tcaccattcgcctcccgtagc

SEQ ID NO: 5448 - DNA, 21 bp, Artificial Sequence
  Synthetic construct
caccattcgcctcccgtagct

SEQ ID NO: 5449 - DNA, 21 bp, Artificial Sequence
  Synthetic construct
accattcgcctcccgtagctt

SEQ ID NO: 5450 - DNA, 21 bp, Artificial Sequence
  Synthetic construct
ccattcgcctcccgtagctta

SEQ ID NO: 5451 - DNA, 21 bp, Artificial Sequence
  Synthetic construct
cattcgcctcccgtagcttag

SEQ ID NO: 5452 - DNA, 21 bp, Artificial Sequence
  Synthetic construct
attcgcctcccgtagcttagc

SEQ ID NO: 5453 - DNA, 21 bp, Artificial Sequence
  Synthetic construct
ttcgcctcccgtagcttagcg

SEQ ID NO: 5454 - DNA, 21 bp, Artificial Sequence
  Synthetic construct
tcgcctcccgtagcttagcga

SEQ ID NO: 5455 - DNA, 21 bp, Artificial Sequence
  Synthetic construct
cgcctcccgtagcttagcgat

SEQ ID NO: 5456 - DNA, 21 bp, Artificial Sequence
  Synthetic construct
gcctcccgtagcttagcgata

SEQ ID NO: 5457 - DNA, 21 bp, Artificial Sequence
  Synthetic construct
cctcccgtagcttagcgatag

SEQ ID NO: 5458 - DNA, 21 bp, Artificial Sequence
  Synthetic construct
ctcccgtagcttagcgatagc

SEQ ID NO: 5459 - DNA, 21 bp, Artificial Sequence
  Synthetic construct
tcccgtagcttagcgatagct

SEQ ID NO: 5460 - DNA, 21 bp, Artificial Sequence
  Synthetic construct
cccgtagcttagcgatagcta

SEQ ID NO: 5461 - DNA, 21 bp, Artificial Sequence
  Synthetic construct
ccgtagcttagcgatagctaa

SEQ ID NO: 5462 - DNA, 21 bp, Artificial Sequence
  Synthetic construct
cgtagcttagcgatagctaag

SEQ ID NO: 5463 - DNA, 21 bp, Artificial Sequence
  Synthetic construct
gtagcttagcgatagctaagg

SEQ ID NO: 5464 - DNA, 21 bp, Artificial Sequence
  Synthetic construct
tagcttagcgatagctaaggt

SEQ ID NO: 5465 - DNA, 21 bp, Artificial Sequence
  Synthetic construct
agcttagcgatagctaaggta

SEQ ID NO: 5466 - DNA, 21 bp, Artificial Sequence
  Synthetic construct
gcttagcgatagctaaggtac

SEQ ID NO: 5467 - DNA, 21 bp, Artificial Sequence
  Synthetic construct
cttagcgatagctaaggtacg

SEQ ID NO: 5468 - DNA, 21 bp, Artificial Sequence
  Synthetic construct
ttagcgatagctaaggtacga

SEQ ID NO: 5469 - DNA, 21 bp, Artificial Sequence
  Synthetic construct
tagcgatagctaaggtacgac

SEQ ID NO: 5470 - DNA, 21 bp, Artificial Sequence
  Synthetic construct
agcgatagctaaggtacgacg

SEQ ID NO: 5471 - DNA, 21 bp, Artificial Sequence
  Synthetic construct
gcgatagctaaggtacgacgg

SEQ ID NO: 5472 - DNA, 21 bp, Artificial Sequence
  Synthetic construct
cgatagctaaggtacgacggg

SEQ ID NO: 5473 - DNA, 21 bp, Artificial Sequence
  Synthetic construct
gatagctaaggtacgacgggt

SEQ ID NO: 5474 - DNA, 21 bp, Artificial Sequence
  Synthetic construct
atagctaaggtacgacgggtc

SEQ ID NO: 5475 - DNA, 21 bp, Artificial Sequence
  Synthetic construct
tagctaaggtacgacgggtcg

SEQ ID NO: 5476 - DNA, 21 bp, Artificial Sequence
  Synthetic construct
agctaaggtacgacgggtcgc

SEQ ID NO: 5477 - DNA, 21 bp, Artificial Sequence
  Synthetic construct
gctaaggtacgacgggtcgcc

SEQ ID NO: 5478 - DNA, 21 bp, Artificial Sequence
  Synthetic construct
ctaaggtacgacgggtcgcct

SEQ ID NO: 5479 - DNA, 21 bp, Artificial Sequence
  Synthetic construct
taaggtacgacgggtcgcctc

SEQ ID NO: 5480 - DNA, 21 bp, Artificial Sequence
  Synthetic construct
aaggtacgacgggtcgcctcg

SEQ ID NO: 5481 - DNA, 21 bp, Artificial Sequence
  Synthetic construct
aggtacgacgggtcgcctcgt

SEQ ID NO: 5482 - DNA, 21 bp, Artificial Sequence
  Synthetic construct
ggtacgacgggtcgcctcgtc

SEQ ID NO: 5483 - DNA, 21 bp, Artificial Sequence
  Synthetic construct
gtacgacgggtcgcctcgtca

SEQ ID NO: 5484 - DNA, 21 bp, Artificial Sequence
  Synthetic construct
tacgacgggtcgcctcgtcat

SEQ ID NO: 5485 - DNA, 21 bp, Artificial Sequence
  Synthetic construct
acgacgggtcgcctcgtcatt

SEQ ID NO: 5486 - DNA, 21 bp, Artificial Sequence
  Synthetic construct
cgacgggtcgcctcgtcatta

SEQ ID NO: 5487 - DNA, 21 bp, Artificial Sequence
  Synthetic construct
gacgggtcgcctcgtcattac

SEQ ID NO: 5488 - DNA, 21 bp, Artificial Sequence
  Synthetic construct
acgggtcgcctcgtcattacc

SEQ ID NO: 5489 - DNA, 21 bp, Artificial Sequence
  Synthetic construct
cgggtcgcctcgtcattacca

SEQ ID NO: 5490 - DNA, 21 bp, Artificial Sequence
  Synthetic construct
gggtcgcctcgtcattaccag

SEQ ID NO: 5491 - DNA, 21 bp, Artificial Sequence
  Synthetic construct
ggtcgcctcgtcattaccaga

SEQ ID NO: 5492 - DNA, 21 bp, Artificial Sequence
  Synthetic construct
gtcgcctcgtcattaccagaa

SEQ ID NO: 5493 - DNA, 21 bp, Artificial Sequence
  Synthetic construct
tcgcctcgtcattaccagaac

SEQ ID NO: 5494 - DNA, 21 bp, Artificial Sequence
  Synthetic construct
cgcctcgtcattaccagaacc

SEQ ID NO: 5495 - DNA, 21 bp, Artificial Sequence
  Synthetic construct
gcctcgtcattaccagaacct

SEQ ID NO: 5496 - DNA, 21 bp, Artificial Sequence
  Synthetic construct
cctcgtcattaccagaaccta

SEQ ID NO: 5497 - DNA, 21 bp, Artificial Sequence
  Synthetic construct
ctcgtcattaccagaacctaa

SEQ ID NO: 5498 - DNA, 21 bp, Artificial Sequence
  Synthetic construct
tcgtcattaccagaacctaag

SEQ ID NO: 5499 - DNA, 21 bp, Artificial Sequence
  Synthetic construct
cgtcattaccagaacctaagg

SEQ ID NO: 5500 - DNA, 21 bp, Artificial Sequence
  Synthetic construct
gtcattaccagaacctaaggt

SEQ ID NO: 5501 - DNA, 21 bp, Artificial Sequence
  Synthetic construct
tcattaccagaacctaaggtc

SEQ ID NO: 5502 - DNA, 21 bp, Artificial Sequence
  Synthetic construct
cattaccagaacctaaggtcg

SEQ ID NO: 5503 - DNA, 21 bp, Artificial Sequence
  Synthetic construct
attaccagaacctaaggtcgg

SEQ ID NO: 5504 - DNA, 21 bp, Artificial Sequence
  Synthetic construct
ttaccagaacctaaggtcgga

SEQ ID NO: 5505 - DNA, 21 bp, Artificial Sequence
  Synthetic construct
taccagaacctaaggtcggat

SEQ ID NO: 5506 - DNA, 21 bp, Artificial Sequence
  Synthetic construct
accagaacctaaggtcggatg

SEQ ID NO: 5507 - DNA, 21 bp, Artificial Sequence
  Synthetic construct
ccagaacctaaggtcggatgc

SEQ ID NO: 5508 - DNA, 21 bp, Artificial Sequence
  Synthetic construct
cagaacctaaggtcggatgct

SEQ ID NO: 5509 - DNA, 21 bp, Artificial Sequence
  Synthetic construct
agaacctaaggtcggatgctt

SEQ ID NO: 5510 - DNA, 21 bp, Artificial Sequence
  Synthetic construct
gaacctaaggtcggatgcttt

SEQ ID NO: 5511 - DNA, 21 bp, Artificial Sequence
  Synthetic construct
aacctaaggtcggatgctttg

SEQ ID NO: 5512 - DNA, 21 bp, Artificial Sequence
  Synthetic construct
acctaaggtcggatgctttgt

SEQ ID NO: 5513 - DNA, 21 bp, Artificial Sequence
  Synthetic construct
cctaaggtcggatgctttgtg

SEQ ID NO: 5514 - DNA, 21 bp, Artificial Sequence
  Synthetic construct
ctaaggtcggatgctttgtga

SEQ ID NO: 5515 - DNA, 21 bp, Artificial Sequence
  Synthetic construct
taaggtcggatgctttgtgag

SEQ ID NO: 5516 - DNA, 21 bp, Artificial Sequence
  Synthetic construct
aaggtcggatgctttgtgagc

SEQ ID NO: 5517 - DNA, 21 bp, Artificial Sequence
  Synthetic construct
aggtcggatgctttgtgagca

SEQ ID NO: 5518 - DNA, 21 bp, Artificial Sequence
  Synthetic construct
ggtcggatgctttgtgagcaa

SEQ ID NO: 5519 - DNA, 21 bp, Artificial Sequence
  Synthetic construct
gtcggatgctttgtgagcaat

SEQ ID NO: 5520 - DNA, 21 bp, Artificial Sequence
  Synthetic construct
tcggatgctttgtgagcaatt

SEQ ID NO: 5521 - DNA, 21 bp, Artificial Sequence
  Synthetic construct
cggatgctttgtgagcaattc

SEQ ID NO: 5522 - DNA, 21 bp, Artificial Sequence
  Synthetic construct
ggatgctttgtgagcaattcg

SEQ ID NO: 5523 - DNA, 21 bp, Artificial Sequence
  Synthetic construct
gatgctttgtgagcaattcgt

SEQ ID NO: 5524 - DNA, 21 bp, Artificial Sequence
  Synthetic construct
atgctttgtgagcaattcgtc

SEQ ID NO: 5525 - DNA, 21 bp, Artificial Sequence
  Synthetic construct
tgctttgtgagcaattcgtcc

SEQ ID NO: 5526 - DNA, 21 bp, Artificial Sequence
  Synthetic construct
gctttgtgagcaattcgtccc

SEQ ID NO: 5527 - DNA, 21 bp, Artificial Sequence
  Synthetic construct
ctttgtgagcaattcgtccct

SEQ ID NO: 5528 - DNA, 21 bp, Artificial Sequence
  Synthetic construct
tttgtgagcaattcgtccctt

SEQ ID NO: 5529 - DNA, 21 bp, Artificial Sequence
  Synthetic construct
ttgtgagcaattcgtccctta

SEQ ID NO: 5530 - DNA, 21 bp, Artificial Sequence
  Synthetic construct
tgtgagcaattcgtcccttaa

SEQ ID NO: 5531 - DNA, 21 bp, Artificial Sequence
  Synthetic construct
gtgagcaattcgtcccttaag

SEQ ID NO: 5532 - DNA, 21 bp, Artificial Sequence
  Synthetic construct
tgagcaattcgtcccttaagt

SEQ ID NO: 5533 - DNA, 21 bp, Artificial Sequence
  Synthetic construct
gagcaattcgtcccttaagta

SEQ ID NO: 5534 - DNA, 21 bp, Artificial Sequence
  Synthetic construct
agcaattcgtcccttaagtaa

SEQ ID NO: 5535 - DNA, 21 bp, Artificial Sequence
  Synthetic construct
gcaattcgtcccttaagtaag

SEQ ID NO: 5536 - DNA, 21 bp, Artificial Sequence
  Synthetic construct
caattcgtcccttaagtaagc

SEQ ID NO: 5537 - DNA, 21 bp, Artificial Sequence
  Synthetic construct
aattcgtcccttaagtaagca

SEQ ID NO: 5538 - DNA, 21 bp, Artificial Sequence
  Synthetic construct
attcgtcccttaagtaagcaa

SEQ ID NO: 5539 - DNA, 21 bp, Artificial Sequence
  Synthetic construct
ttcgtcccttaagtaagcaat

SEQ ID NO: 5540 - DNA, 21 bp, Artificial Sequence
  Synthetic construct
tcgtcccttaagtaagcaatt

SEQ ID NO: 5541 - DNA, 21 bp, Artificial Sequence
  Synthetic construct
cgtcccttaagtaagcaattg

SEQ ID NO: 5542 - DNA, 21 bp, Artificial Sequence
  Synthetic construct
gtcccttaagtaagcaattgc

SEQ ID NO: 5543 - DNA, 21 bp, Artificial Sequence
  Synthetic construct
tcccttaagtaagcaattgct

SEQ ID NO: 5544 - DNA, 21 bp, Artificial Sequence
  Synthetic construct
cccttaagtaagcaattgctg

SEQ ID NO: 5545 - DNA, 21 bp, Artificial Sequence
  Synthetic construct
ccttaagtaagcaattgctgt

SEQ ID NO: 5546 - DNA, 21 bp, Artificial Sequence
  Synthetic construct
cttaagtaagcaattgctgta

SEQ ID NO: 5547 - DNA, 21 bp, Artificial Sequence
  Synthetic construct
ttaagtaagcaattgctgtaa

SEQ ID NO: 5548 - DNA, 21 bp, Artificial Sequence
  Synthetic construct
taagtaagcaattgctgtaaa

SEQ ID NO: 5549 - DNA, 21 bp, Artificial Sequence
  Synthetic construct
aagtaagcaattgctgtaaag

SEQ ID NO: 5550 - DNA, 21 bp, Artificial Sequence
  Synthetic construct
agtaagcaattgctgtaaagt

SEQ ID NO: 5551 - DNA, 21 bp, Artificial Sequence
  Synthetic construct
gtaagcaattgctgtaaagtc

SEQ ID NO: 5552 - DNA, 21 bp, Artificial Sequence
  Synthetic construct
taagcaattgctgtaaagtcg

SEQ ID NO: 5553 - DNA, 21 bp, Artificial Sequence
  Synthetic construct
aagcaattgctgtaaagtcgt

SEQ ID NO: 5554 - DNA, 21 bp, Artificial Sequence
  Synthetic construct
agcaattgctgtaaagtcgtc

SEQ ID NO: 5555 - DNA, 21 bp, Artificial Sequence
  Synthetic construct
gcaattgctgtaaagtcgtca

SEQ ID NO: 5556 - DNA, 21 bp, Artificial Sequence
  Synthetic construct
caattgctgtaaagtcgtcac

SEQ ID NO: 5557 - DNA, 21 bp, Artificial Sequence
  Synthetic construct
aattgctgtaaagtcgtcact

SEQ ID NO: 5558 - DNA, 21 bp, Artificial Sequence
  Synthetic construct
attgctgtaaagtcgtcactg

SEQ ID NO: 5559 - DNA, 21 bp, Artificial Sequence
  Synthetic construct
ttgctgtaaagtcgtcactgt

SEQ ID NO: 5560 - DNA, 21 bp, Artificial Sequence
  Synthetic construct
tgctgtaaagtcgtcactgtg

SEQ ID NO: 5561 - DNA, 21 bp, Artificial Sequence
  Synthetic construct
gctgtaaagtcgtcactgtgc

SEQ ID NO: 5562 - DNA, 21 bp, Artificial Sequence
  Synthetic construct
ctgtaaagtcgtcactgtgcg

SEQ ID NO: 5563 - DNA, 21 bp, Artificial Sequence
  Synthetic construct
tgtaaagtcgtcactgtgcgg

SEQ ID NO: 5564 - DNA, 21 bp, Artificial Sequence
  Synthetic construct
gtaaagtcgtcactgtgcgga

SEQ ID NO: 5565 - DNA, 21 bp, Artificial Sequence
  Synthetic construct
taaagtcgtcactgtgcggat

SEQ ID NO: 5566 - DNA, 21 bp, Artificial Sequence
  Synthetic construct
aaagtcgtcactgtgcggatc

SEQ ID NO: 5567 - DNA, 21 bp, Artificial Sequence
  Synthetic construct
aagtcgtcactgtgcggatca

SEQ ID NO: 5568 - DNA, 21 bp, Artificial Sequence
  Synthetic construct
agtcgtcactgtgcggatcac

SEQ ID NO: 5569 - DNA, 21 bp, Artificial Sequence
  Synthetic construct
gtcgtcactgtgcggatcacc

SEQ ID NO: 5570 - DNA, 21 bp, Artificial Sequence
  Synthetic construct
tcgtcactgtgcggatcaccg

SEQ ID NO: 5571 - DNA, 21 bp, Artificial Sequence
  Synthetic construct
cgtcactgtgcggatcaccgc

SEQ ID NO: 5572 - DNA, 21 bp, Artificial Sequence
  Synthetic construct
gtcactgtgcggatcaccgct

SEQ ID NO: 5573 - DNA, 21 bp, Artificial Sequence
  Synthetic construct
tcactgtgcggatcaccgctt

SEQ ID NO: 5574 - DNA, 21 bp, Artificial Sequence
  Synthetic construct
cactgtgcggatcaccgcttc

SEQ ID NO: 5575 - DNA, 21 bp, Artificial Sequence
  Synthetic construct
actgtgcggatcaccgcttcc

SEQ ID NO: 5576 - DNA, 21 bp, Artificial Sequence
  Synthetic construct
ctgtgcggatcaccgcttcca

SEQ ID NO: 5577 - DNA, 21 bp, Artificial Sequence
  Synthetic construct
tgtgcggatcaccgcttccag

SEQ ID NO: 5578 - DNA, 21 bp, Artificial Sequence
  Synthetic construct
gtgcggatcaccgcttccagt

SEQ ID NO: 5579 - DNA, 21 bp, Artificial Sequence
  Synthetic construct
tgcggatcaccgcttccagta

SEQ ID NO: 5580 - DNA, 21 bp, Artificial Sequence
  Synthetic construct
gcggatcaccgcttccagtag

SEQ ID NO: 5581 - DNA, 21 bp, Artificial Sequence
  Synthetic construct
cggatcaccgcttccagtagc

SEQ ID NO: 5582 - DNA, 21 bp, Artificial Sequence
  Synthetic construct
ggatcaccgcttccagtagcg

SEQ ID NO: 5583 - DNA, 21 bp, Artificial Sequence
  Synthetic construct
gatcaccgcttccagtagcga

SEQ ID NO: 5584 - DNA, 21 bp, Artificial Sequence
  Synthetic construct
atcaccgcttccagtagcgac

SEQ ID NO: 5585 - DNA, 21 bp, Artificial Sequence
  Synthetic construct
tcaccgcttccagtagcgaca

SEQ ID NO: 5586 - DNA, 21 bp, Artificial Sequence
  Synthetic construct
caccgcttccagtagcgacag

SEQ ID NO: 5587 - DNA, 21 bp, Artificial Sequence
  Synthetic construct
accgcttccagtagcgacaga

SEQ ID NO: 5588 - DNA, 21 bp, Artificial Sequence
  Synthetic construct
ccgcttccagtagcgacagaa

SEQ ID NO: 5589 - DNA, 21 bp, Artificial Sequence
  Synthetic construct
cgcttccagtagcgacagaag

SEQ ID NO: 5590 - DNA, 21 bp, Artificial Sequence
  Synthetic construct
gcttccagtagcgacagaagc

SEQ ID NO: 5591 - DNA, 21 bp, Artificial Sequence
  Synthetic construct
cttccagtagcgacagaagca

SEQ ID NO: 5592 - DNA, 21 bp, Artificial Sequence
  Synthetic construct
ttccagtagcgacagaagcaa

SEQ ID NO: 5593 - DNA, 21 bp, Artificial Sequence
  Synthetic construct
tccagtagcgacagaagcaat

SEQ ID NO: 5594 - DNA, 21 bp, Artificial Sequence
  Synthetic construct
ccagtagcgacagaagcaatt

SEQ ID NO: 5595 - DNA, 21 bp, Artificial Sequence
  Synthetic construct
cagtagcgacagaagcaattg

SEQ ID NO: 5596 - DNA, 21 bp, Artificial Sequence
  Synthetic construct
agtagcgacagaagcaattga

SEQ ID NO: 5597 - DNA, 21 bp, Artificial Sequence
  Synthetic construct
gtagcgacagaagcaattgat

SEQ ID NO: 5598 - DNA, 21 bp, Artificial Sequence
  Synthetic construct
tagcgacagaagcaattgatt

SEQ ID NO: 5599 - DNA, 21 bp, Artificial Sequence
  Synthetic construct
agcgacagaagcaattgattg

SEQ ID NO: 5600 - DNA, 21 bp, Artificial Sequence
  Synthetic construct
gcgacagaagcaattgattgg

SEQ ID NO: 5601 - DNA, 21 bp, Artificial Sequence
  Synthetic construct
cgacagaagcaattgattggt

SEQ ID NO: 5602 - DNA, 21 bp, Artificial Sequence
  Synthetic construct
gacagaagcaattgattggta

SEQ ID NO: 5603 - DNA, 21 bp, Artificial Sequence
  Synthetic construct
acagaagcaattgattggtaa

SEQ ID NO: 5604 - DNA, 21 bp, Artificial Sequence
  Synthetic construct
cagaagcaattgattggtaaa

SEQ ID NO: 5605 - DNA, 21 bp, Artificial Sequence
  Synthetic construct
agaagcaattgattggtaaat

SEQ ID NO: 5606 - DNA, 21 bp, Artificial Sequence
  Synthetic construct
gaagcaattgattggtaaatt

SEQ ID NO: 5607 - DNA, 21 bp, Artificial Sequence
  Synthetic construct
aagcaattgattggtaaattt

SEQ ID NO: 5608 - DNA, 21 bp, Artificial Sequence
  Synthetic construct
agcaattgattggtaaatttc

SEQ ID NO: 5609 - DNA, 21 bp, Artificial Sequence
  Synthetic construct
gcaattgattggtaaatttcg

SEQ ID NO: 5610 - DNA, 21 bp, Artificial Sequence
  Synthetic construct
caattgattggtaaatttcga

SEQ ID NO: 5611 - DNA, 21 bp, Artificial Sequence
  Synthetic construct
aattgattggtaaatttcgag

SEQ ID NO: 5612 - DNA, 21 bp, Artificial Sequence
  Synthetic construct
attgattggtaaatttcgaga

SEQ ID NO: 5613 - DNA, 21 bp, Artificial Sequence
  Synthetic construct
ttgattggtaaatttcgagag

SEQ ID NO: 5614 - DNA, 21 bp, Artificial Sequence
  Synthetic construct
tgattggtaaatttcgagaga

SEQ ID NO: 5615 - DNA, 21 bp, Artificial Sequence
  Synthetic construct
gattggtaaatttcgagagaa

SEQ ID NO: 5616 - DNA, 21 bp, Artificial Sequence
  Synthetic construct
attggtaaatttcgagagaaa

SEQ ID NO: 5617 - DNA, 21 bp, Artificial Sequence
  Synthetic construct
ttggtaaatttcgagagaaag

SEQ ID NO: 5618 - DNA, 21 bp, Artificial Sequence
  Synthetic construct
tggtaaatttcgagagaaaga

SEQ ID NO: 5619 - DNA, 21 bp, Artificial Sequence
  Synthetic construct
ggtaaatttcgagagaaagat

SEQ ID NO: 5620 - DNA, 21 bp, Artificial Sequence
  Synthetic construct
gtaaatttcgagagaaagatc

SEQ ID NO: 5621 - DNA, 21 bp, Artificial Sequence
  Synthetic construct
taaatttcgagagaaagatcg

SEQ ID NO: 5622 - DNA, 21 bp, Artificial Sequence
  Synthetic construct
aaatttcgagagaaagatcgc

SEQ ID NO: 5623 - DNA, 21 bp, Artificial Sequence
  Synthetic construct
aatttcgagagaaagatcgcg

SEQ ID NO: 5624 - DNA, 21 bp, Artificial Sequence
  Synthetic construct
atttcgagagaaagatcgcga

SEQ ID NO: 5625 - DNA, 21 bp, Artificial Sequence
  Synthetic construct
tttcgagagaaagatcgcgag

SEQ ID NO: 5626 - DNA, 21 bp, Artificial Sequence
  Synthetic construct
ttcgagagaaagatcgcgagg

SEQ ID NO: 5627 - DNA, 21 bp, Artificial Sequence
  Synthetic construct
tcgagagaaagatcgcgagga

SEQ ID NO: 5628 - DNA, 21 bp, Artificial Sequence
  Synthetic construct
cgagagaaagatcgcgaggaa

SEQ ID NO: 5629 - DNA, 21 bp, Artificial Sequence
  Synthetic construct
gagagaaagatcgcgaggaag

SEQ ID NO: 5630 - DNA, 21 bp, Artificial Sequence
  Synthetic construct
agagaaagatcgcgaggaaga

SEQ ID NO: 5631 - DNA, 21 bp, Artificial Sequence
  Synthetic construct
gagaaagatcgcgaggaagat

SEQ ID NO: 5632 - DNA, 21 bp, Artificial Sequence
  Synthetic construct
agaaagatcgcgaggaagatc

SEQ ID NO: 5633 - DNA, 21 bp, Artificial Sequence
  Synthetic construct
gaaagatcgcgaggaagatca

SEQ ID NO: 5634 - DNA, 21 bp, Artificial Sequence
  Synthetic construct
aaagatcgcgaggaagatcaa

SEQ ID NO: 5635 - DNA, 21 bp, Artificial Sequence
  Synthetic construct
aagatcgcgaggaagatcaat

SEQ ID NO: 5636 - DNA, 21 bp, Artificial Sequence
  Synthetic construct
agatcgcgaggaagatcaata

SEQ ID NO: 5637 - DNA, 21 bp, Artificial Sequence
  Synthetic construct
gatcgcgaggaagatcaatac

SEQ ID NO: 5638 - DNA, 21 bp, Artificial Sequence
  Synthetic construct
atcgcgaggaagatcaataca

SEQ ID NO: 5639 - DNA, 21 bp, Artificial Sequence
  Synthetic construct
tcgcgaggaagatcaatacat

SEQ ID NO: 5640 - DNA, 21 bp, Artificial Sequence
  Synthetic construct
cgcgaggaagatcaatacata

SEQ ID NO: 5641 - DNA, 21 bp, Artificial Sequence
  Synthetic construct
gcgaggaagatcaatacataa

SEQ ID NO: 5642 - DNA, 21 bp, Artificial Sequence
  Synthetic construct
cgaggaagatcaatacataaa

SEQ ID NO: 5643 - DNA, 21 bp, Artificial Sequence
  Synthetic construct
gaggaagatcaatacataaag

SEQ ID NO: 5644 - DNA, 21 bp, Artificial Sequence
  Synthetic construct
aggaagatcaatacataaaga

SEQ ID NO: 5645 - DNA, 21 bp, Artificial Sequence
  Synthetic construct
ggaagatcaatacataaagag

SEQ ID NO: 5646 - DNA, 21 bp, Artificial Sequence
  Synthetic construct
gaagatcaatacataaagagt

SEQ ID NO: 5647 - DNA, 21 bp, Artificial Sequence
  Synthetic construct
aagatcaatacataaagagtt

SEQ ID NO: 5648 - DNA, 21 bp, Artificial Sequence
  Synthetic construct
agatcaatacataaagagttg

SEQ ID NO: 5649 - DNA, 21 bp, Artificial Sequence
  Synthetic construct
gatcaatacataaagagttga

SEQ ID NO: 5650 - DNA, 21 bp, Artificial Sequence
  Synthetic construct
atcaatacataaagagttgaa

SEQ ID NO: 5651 - DNA, 21 bp, Artificial Sequence
  Synthetic construct
tcaatacataaagagttgaac

SEQ ID NO: 5652 - DNA, 21 bp, Artificial Sequence
  Synthetic construct
caatacataaagagttgaact

SEQ ID NO: 5653 - DNA, 21 bp, Artificial Sequence
  Synthetic construct
aatacataaagagttgaactt

SEQ ID NO: 5654 - DNA, 21 bp, Artificial Sequence
  Synthetic construct
atacataaagagttgaacttc

SEQ ID NO: 5655 - DNA, 21 bp, Artificial Sequence
  Synthetic construct
tacataaagagttgaacttct

SEQ ID NO: 5656 - DNA, 21 bp, Artificial Sequence
  Synthetic construct
acataaagagttgaacttctt

SEQ ID NO: 5657 - DNA, 21 bp, Artificial Sequence
  Synthetic construct
cataaagagttgaacttcttt

SEQ ID NO: 5658 - DNA, 21 bp, Artificial Sequence
  Synthetic construct
ataaagagttgaacttctttg

SEQ ID NO: 5659 - DNA, 21 bp, Artificial Sequence
  Synthetic construct
taaagagttgaacttctttgt

SEQ ID NO: 5660 - DNA, 21 bp, Artificial Sequence
  Synthetic construct
aaagagttgaacttctttgtt

SEQ ID NO: 5661 - DNA, 21 bp, Artificial Sequence
  Synthetic construct
aagagttgaacttctttgttg

SEQ ID NO: 5662 - DNA, 21 bp, Artificial Sequence
  Synthetic construct
agagttgaacttctttgttgt

SEQ ID NO: 5663 - DNA, 21 bp, Artificial Sequence
  Synthetic construct
gagttgaacttctttgttgtc

SEQ ID NO: 5664 - DNA, 21 bp, Artificial Sequence
  Synthetic construct
agttgaacttctttgttgtct

SEQ ID NO: 5665 - DNA, 21 bp, Artificial Sequence
  Synthetic construct
gttgaacttctttgttgtctt

SEQ ID NO: 5666 - DNA, 21 bp, Artificial Sequence
  Synthetic construct
ttgaacttctttgttgtcttc

SEQ ID NO: 5667 - DNA, 21 bp, Artificial Sequence
  Synthetic construct
tgaacttctttgttgtcttcg

SEQ ID NO: 5668 - DNA, 21 bp, Artificial Sequence
  Synthetic construct
gaacttctttgttgtcttcga

SEQ ID NO: 5669 - DNA, 21 bp, Artificial Sequence
  Synthetic construct
aacttctttgttgtcttcgac

SEQ ID NO: 5670 - DNA, 21 bp, Artificial Sequence
  Synthetic construct
acttctttgttgtcttcgaca

SEQ ID NO: 5671 - DNA, 21 bp, Artificial Sequence
  Synthetic construct
cttctttgttgtcttcgacat

SEQ ID NO: 5672 - DNA, 21 bp, Artificial Sequence
  Synthetic construct
ttctttgttgtcttcgacatg

SEQ ID NO: 5673 - DNA, 21 bp, Artificial Sequence
  Synthetic construct
tctttgttgtcttcgacatgg

SEQ ID NO: 5674 - DNA, 21 bp, Artificial Sequence
  Synthetic construct
ctttgttgtcttcgacatggg

SEQ ID NO: 5675 - DNA, 21 bp, Artificial Sequence
  Synthetic construct
tttgttgtcttcgacatgggt

SEQ ID NO: 5676 - DNA, 21 bp, Artificial Sequence
  Synthetic construct
ttgttgtcttcgacatgggta

SEQ ID NO: 5677 - DNA, 21 bp, Artificial Sequence
  Synthetic construct
tgttgtcttcgacatgggtaa

SEQ ID NO: 5678 - DNA, 21 bp, Artificial Sequence
  Synthetic construct
gttgtcttcgacatgggtaat

SEQ ID NO: 5679 - DNA, 21 bp, Artificial Sequence
  Synthetic construct
ttgtcttcgacatgggtaatc

SEQ ID NO: 5680 - DNA, 21 bp, Artificial Sequence
  Synthetic construct
tgtcttcgacatgggtaatcc

SEQ ID NO: 5681 - DNA, 21 bp, Artificial Sequence
  Synthetic construct
gtcttcgacatgggtaatcct

SEQ ID NO: 5682 - DNA, 21 bp, Artificial Sequence
  Synthetic construct
tcttcgacatgggtaatcctc

SEQ ID NO: 5683 - DNA, 21 bp, Artificial Sequence
  Synthetic construct
cttcgacatgggtaatcctca

SEQ ID NO: 5684 - DNA, 21 bp, Artificial Sequence
  Synthetic construct
ttcgacatgggtaatcctcat

SEQ ID NO: 5685 - DNA, 21 bp, Artificial Sequence
  Synthetic construct
tcgacatgggtaatcctcatg

SEQ ID NO: 5686 - DNA, 21 bp, Artificial Sequence
  Synthetic construct
cgacatgggtaatcctcatgt

SEQ ID NO: 5687 - DNA, 21 bp, Artificial Sequence
  Synthetic construct
gacatgggtaatcctcatgtt

SEQ ID NO: 5688 - DNA, 21 bp, Artificial Sequence
  Synthetic construct
acatgggtaatcctcatgttt

SEQ ID NO: 5689 - DNA, 21 bp, Artificial Sequence
  Synthetic construct
catgggtaatcctcatgtttg

SEQ ID NO: 5690 - DNA, 21 bp, Artificial Sequence
  Synthetic construct
atgggtaatcctcatgtttga

SEQ ID NO: 5691 - DNA, 21 bp, Artificial Sequence
  Synthetic construct
tgggtaatcctcatgtttgaa

SEQ ID NO: 5692 - DNA, 21 bp, Artificial Sequence
  Synthetic construct
gggtaatcctcatgtttgaat

SEQ ID NO: 5693 - DNA, 21 bp, Artificial Sequence
  Synthetic construct
ggtaatcctcatgtttgaatg

SEQ ID NO: 5694 - DNA, 21 bp, Artificial Sequence
  Synthetic construct
gtaatcctcatgtttgaatgg

SEQ ID NO: 5695 - DNA, 21 bp, Artificial Sequence
  Synthetic construct
taatcctcatgtttgaatggc

SEQ ID NO: 5696 - DNA, 21 bp, Artificial Sequence
  Synthetic construct
aatcctcatgtttgaatggcc

SEQ ID NO: 5697 - DNA, 21 bp, Artificial Sequence
  Synthetic construct
atcctcatgtttgaatggccg

SEQ ID NO: 5698 - DNA, 21 bp, Artificial Sequence
  Synthetic construct
tcctcatgtttgaatggccgg

SEQ ID NO: 5699 - DNA, 21 bp, Artificial Sequence
  Synthetic construct
cctcatgtttgaatggccggc

SEQ ID NO: 5700 - DNA, 21 bp, Artificial Sequence
  Synthetic construct
ctcatgtttgaatggccggcg

SEQ ID NO: 5701 - DNA, 21 bp, Artificial Sequence
  Synthetic construct
tcatgtttgaatggccggcgt

SEQ ID NO: 5702 - DNA, 21 bp, Artificial Sequence
  Synthetic construct
catgtttgaatggccggcgtc

SEQ ID NO: 5703 - DNA, 21 bp, Artificial Sequence
  Synthetic construct
atgtttgaatggccggcgtct

SEQ ID NO: 5704 - DNA, 21 bp, Artificial Sequence
  Synthetic construct
tgtttgaatggccggcgtcta

SEQ ID NO: 5705 - DNA, 21 bp, Artificial Sequence
  Synthetic construct
gtttgaatggccggcgtctat

SEQ ID NO: 5706 - DNA, 21 bp, Artificial Sequence
  Synthetic construct
tttgaatggccggcgtctatt

SEQ ID NO: 5707 - DNA, 21 bp, Artificial Sequence
  Synthetic construct
ttgaatggccggcgtctatta

SEQ ID NO: 5708 - DNA, 21 bp, Artificial Sequence
  Synthetic construct
tgaatggccggcgtctattag

SEQ ID NO: 5709 - DNA, 21 bp, Artificial Sequence
  Synthetic construct
gaatggccggcgtctattagt

SEQ ID NO: 5710 - DNA, 21 bp, Artificial Sequence
  Synthetic construct
aatggccggcgtctattagta

SEQ ID NO: 5711 - DNA, 21 bp, Artificial Sequence
  Synthetic construct
atggccggcgtctattagtag

SEQ ID NO: 5712 - DNA, 21 bp, Artificial Sequence
  Synthetic construct
tggccggcgtctattagtaga

SEQ ID NO: 5713 - DNA, 21 bp, Artificial Sequence
  Synthetic construct
ggccggcgtctattagtagat

SEQ ID NO: 5714 - DNA, 21 bp, Artificial Sequence
  Synthetic construct
gccggcgtctattagtagatg

SEQ ID NO: 5715 - DNA, 21 bp, Artificial Sequence
  Synthetic construct
ccggcgtctattagtagatgc

SEQ ID NO: 5716 - DNA, 21 bp, Artificial Sequence
  Synthetic construct
cggcgtctattagtagatgcc

SEQ ID NO: 5717 - DNA, 21 bp, Artificial Sequence
  Synthetic construct
ggcgtctattagtagatgccg

SEQ ID NO: 5718 - DNA, 21 bp, Artificial Sequence
  Synthetic construct
gcgtctattagtagatgccgg

SEQ ID NO: 5719 - DNA, 21 bp, Artificial Sequence
  Synthetic construct
cgtctattagtagatgccgga

SEQ ID NO: 5720 - DNA, 21 bp, Artificial Sequence
  Synthetic construct
gtctattagtagatgccggag

SEQ ID NO: 5721 - DNA, 21 bp, Artificial Sequence
  Synthetic construct
tctattagtagatgccggagt

SEQ ID NO: 5722 - DNA, 21 bp, Artificial Sequence
  Synthetic construct
ctattagtagatgccggagtt

SEQ ID NO: 5723 - DNA, 21 bp, Artificial Sequence
  Synthetic construct
tattagtagatgccggagttt

SEQ ID NO: 5724 - DNA, 21 bp, Artificial Sequence
  Synthetic construct
attagtagatgccggagtttg

SEQ ID NO: 5725 - DNA, 21 bp, Artificial Sequence
  Synthetic construct
ttagtagatgccggagtttgc

SEQ ID NO: 5726 - DNA, 21 bp, Artificial Sequence
  Synthetic construct
tagtagatgccggagtttgct

SEQ ID NO: 5727 - DNA, 21 bp, Artificial Sequence
  Synthetic construct
agtagatgccggagtttgctg

SEQ ID NO: 5728 - DNA, 21 bp, Artificial Sequence
  Synthetic construct
gtagatgccggagtttgctgc

SEQ ID NO: 5729 - DNA, 21 bp, Artificial Sequence
  Synthetic construct
tagatgccggagtttgctgcg

SEQ ID NO: 5730 - DNA, 21 bp, Artificial Sequence
  Synthetic construct
agatgccggagtttgctgcga

SEQ ID NO: 5731 - DNA, 21 bp, Artificial Sequence
  Synthetic construct
gatgccggagtttgctgcgat

SEQ ID NO: 5732 - DNA, 21 bp, Artificial Sequence
  Synthetic construct
atgccggagtttgctgcgatt

SEQ ID NO: 5733 - DNA, 21 bp, Artificial Sequence
  Synthetic construct
tgccggagtttgctgcgattg

SEQ ID NO: 5734 - DNA, 21 bp, Artificial Sequence
  Synthetic construct
gccggagtttgctgcgattgc

SEQ ID NO: 5735 - DNA, 21 bp, Artificial Sequence
  Synthetic construct
ccggagtttgctgcgattgct

SEQ ID NO: 5736 - DNA, 21 bp, Artificial Sequence
  Synthetic construct
cggagtttgctgcgattgctg

SEQ ID NO: 5737 - DNA, 21 bp, Artificial Sequence
  Synthetic construct
ggagtttgctgcgattgctga

SEQ ID NO: 5738 - DNA, 21 bp, Artificial Sequence
  Synthetic construct
gagtttgctgcgattgctgag

SEQ ID NO: 5739 - DNA, 21 bp, Artificial Sequence
  Synthetic construct
agtttgctgcgattgctgagg

SEQ ID NO: 5740 - DNA, 21 bp, Artificial Sequence
  Synthetic construct
gtttgctgcgattgctgaggg

SEQ ID NO: 5741 - DNA, 21 bp, Artificial Sequence
  Synthetic construct
tttgctgcgattgctgaggga

SEQ ID NO: 5742 - DNA, 21 bp, Artificial Sequence
  Synthetic construct
ttgctgcgattgctgagggaa

SEQ ID NO: 5743 - DNA, 21 bp, Artificial Sequence
  Synthetic construct
tgctgcgattgctgagggaat

SEQ ID NO: 5744 - DNA, 21 bp, Artificial Sequence
  Synthetic construct
gctgcgattgctgagggaatc

SEQ ID NO: 5745 - DNA, 21 bp, Artificial Sequence
  Synthetic construct
ctgcgattgctgagggaatcg

SEQ ID NO: 5746 - DNA, 21 bp, Artificial Sequence
  Synthetic construct
tgcgattgctgagggaatcgg

SEQ ID NO: 5747 - DNA, 21 bp, Artificial Sequence
  Synthetic construct
gcgattgctgagggaatcggg

SEQ ID NO: 5748 - DNA, 21 bp, Artificial Sequence
  Synthetic construct
cgattgctgagggaatcgggt

SEQ ID NO: 5749 - DNA, 21 bp, Artificial Sequence
  Synthetic construct
gattgctgagggaatcgggtt

SEQ ID NO: 5750 - DNA, 21 bp, Artificial Sequence
  Synthetic construct
attgctgagggaatcgggttt

SEQ ID NO: 5751 - DNA, 21 bp, Artificial Sequence
  Synthetic construct
ttgctgagggaatcgggtttc

SEQ ID NO: 5752 - DNA, 21 bp, Artificial Sequence
  Synthetic construct
tgctgagggaatcgggtttcc

SEQ ID NO: 5753 - DNA, 21 bp, Artificial Sequence
  Synthetic construct
gctgagggaatcgggtttcca

SEQ ID NO: 5754 - DNA, 21 bp, Artificial Sequence
  Synthetic construct
ctgagggaatcgggtttccat

SEQ ID NO: 5755 - DNA, 21 bp, Artificial Sequence
  Synthetic construct
tgagggaatcgggtttccatc

SEQ ID NO: 5756 - DNA, 21 bp, Artificial Sequence
  Synthetic construct
gagggaatcgggtttccatct

SEQ ID NO: 5757 - DNA, 21 bp, Artificial Sequence
  Synthetic construct
agggaatcgggtttccatctt

SEQ ID NO: 5758 - DNA, 21 bp, Artificial Sequence
  Synthetic construct
gggaatcgggtttccatcttt

SEQ ID NO: 5759 - DNA, 21 bp, Artificial Sequence
  Synthetic construct
ggaatcgggtttccatctttt

SEQ ID NO: 5760 - DNA, 21 bp, Artificial Sequence
  Synthetic construct
gaatcgggtttccatctttta

SEQ ID NO: 5761 - DNA, 21 bp, Artificial Sequence
  Synthetic construct
aatcgggtttccatcttttag

SEQ ID NO: 5762 - DNA, 21 bp, Artificial Sequence
  Synthetic construct
atcgggtttccatcttttagg

SEQ ID NO: 5763 - DNA, 21 bp, Artificial Sequence
  Synthetic construct
tcgggtttccatcttttagga

SEQ ID NO: 5764 - DNA, 21 bp, Artificial Sequence
  Synthetic construct
cgggtttccatcttttaggag

SEQ ID NO: 5765 - DNA, 21 bp, Artificial Sequence
  Synthetic construct
gggtttccatcttttaggaga

SEQ ID NO: 5766 - DNA, 21 bp, Artificial Sequence
  Synthetic construct
ggtttccatcttttaggagac

SEQ ID NO: 5767 - DNA, 21 bp, Artificial Sequence
  Synthetic construct
gtttccatcttttaggagacc

SEQ ID NO: 5768 - DNA, 21 bp, Artificial Sequence
  Synthetic construct
tttccatcttttaggagacct

SEQ ID NO: 5769 - DNA, 21 bp, Artificial Sequence
  Synthetic construct
ttccatcttttaggagacctt

SEQ ID NO: 5770 - DNA, 21 bp, Artificial Sequence
  Synthetic construct
tccatcttttaggagaccttg

SEQ ID NO: 5771 - DNA, 21 bp, Artificial Sequence
  Synthetic construct
ccatcttttaggagaccttgc

SEQ ID NO: 5772 - DNA, 21 bp, Artificial Sequence
  Synthetic construct
catcttttaggagaccttgca

SEQ ID NO: 5773 - DNA, 21 bp, Artificial Sequence
  Synthetic construct
atcttttaggagaccttgcat

SEQ ID NO: 5774 - DNA, 21 bp, Artificial Sequence
  Synthetic construct
tcttttaggagaccttgcatt

SEQ ID NO: 5775 - DNA, 21 bp, Artificial Sequence
  Synthetic construct
cttttaggagaccttgcattg

SEQ ID NO: 5776 - DNA, 21 bp, Artificial Sequence
  Synthetic construct
ttttaggagaccttgcattgc

SEQ ID NO: 5777 - DNA, 21 bp, Artificial Sequence
  Synthetic construct
tttaggagaccttgcattgcc

SEQ ID NO: 5778 - DNA, 21 bp, Artificial Sequence
  Synthetic construct
ttaggagaccttgcattgcct

SEQ ID NO: 5779 - DNA, 21 bp, Artificial Sequence
  Synthetic construct
taggagaccttgcattgcctt

SEQ ID NO: 5780 - DNA, 21 bp, Artificial Sequence
  Synthetic construct
aggagaccttgcattgcctta

SEQ ID NO: 5781 - DNA, 21 bp, Artificial Sequence
  Synthetic construct
ggagaccttgcattgccttaa

SEQ ID NO: 5782 - DNA, 21 bp, Artificial Sequence
  Synthetic construct
gagaccttgcattgccttaac

SEQ ID NO: 5783 - DNA, 21 bp, Artificial Sequence
  Synthetic construct
agaccttgcattgccttaaca

SEQ ID NO: 5784 - DNA, 21 bp, Artificial Sequence
  Synthetic construct
gaccttgcattgccttaacaa

SEQ ID NO: 5785 - DNA, 21 bp, Artificial Sequence
  Synthetic construct
accttgcattgccttaacaat

SEQ ID NO: 5786 - DNA, 21 bp, Artificial Sequence
  Synthetic construct
ccttgcattgccttaacaata

SEQ ID NO: 5787 - DNA, 21 bp, Artificial Sequence
  Synthetic construct
cttgcattgccttaacaataa

SEQ ID NO: 5788 - DNA, 21 bp, Artificial Sequence
  Synthetic construct
ttgcattgccttaacaataag

SEQ ID NO: 5789 - DNA, 21 bp, Artificial Sequence
  Synthetic construct
tgcattgccttaacaataagc

SEQ ID NO: 5790 - DNA, 21 bp, Artificial Sequence
  Synthetic construct
gcattgccttaacaataagct

SEQ ID NO: 5791 - DNA, 21 bp, Artificial Sequence
  Synthetic construct
cattgccttaacaataagctc

SEQ ID NO: 5792 - DNA, 21 bp, Artificial Sequence
  Synthetic construct
attgccttaacaataagctcg

SEQ ID NO: 5793 - DNA, 21 bp, Artificial Sequence
  Synthetic construct
ttgccttaacaataagctcgc

SEQ ID NO: 5794 - DNA, 21 bp, Artificial Sequence
  Synthetic construct
tgccttaacaataagctcgca

SEQ ID NO: 5795 - DNA, 21 bp, Artificial Sequence
  Synthetic construct
gccttaacaataagctcgcag

SEQ ID NO: 5796 - DNA, 21 bp, Artificial Sequence
  Synthetic construct
ccttaacaataagctcgcagt

SEQ ID NO: 5797 - DNA, 21 bp, Artificial Sequence
  Synthetic construct
cttaacaataagctcgcagtc

SEQ ID NO: 5798 - DNA, 21 bp, Artificial Sequence
  Synthetic construct
ttaacaataagctcgcagtcg

SEQ ID NO: 5799 - DNA, 21 bp, Artificial Sequence
  Synthetic construct
taacaataagctcgcagtcgg

SEQ ID NO: 5800 - DNA, 21 bp, Artificial Sequence
  Synthetic construct
aacaataagctcgcagtcgga

SEQ ID NO: 5801 - DNA, 21 bp, Artificial Sequence
  Synthetic construct
acaataagctcgcagtcggaa

SEQ ID NO: 5802 - DNA, 21 bp, Artificial Sequence
  Synthetic construct
caataagctcgcagtcggaat

SEQ ID NO: 5803 - DNA, 21 bp, Artificial Sequence
  Synthetic construct
aataagctcgcagtcggaatt

SEQ ID NO: 5804 - DNA, 21 bp, Artificial Sequence
  Synthetic construct
ataagctcgcagtcggaattc

SEQ ID NO: 5805 - DNA, 21 bp, Artificial Sequence
  Synthetic construct
taagctcgcagtcggaattcg

SEQ ID NO: 5806 - DNA, 21 bp, Artificial Sequence
  Synthetic construct
aagctcgcagtcggaattcgt

SEQ ID NO: 5807 - DNA, 21 bp, Artificial Sequence
  Synthetic construct
agctcgcagtcggaattcgta

SEQ ID NO: 5808 - DNA, 21 bp, Artificial Sequence
  Synthetic construct
gctcgcagtcggaattcgtag

SEQ ID NO: 5809 - DNA, 21 bp, Artificial Sequence
  Synthetic construct
ctcgcagtcggaattcgtagc

SEQ ID NO: 5810 - DNA, 21 bp, Artificial Sequence
  Synthetic construct
tcgcagtcggaattcgtagcg

SEQ ID NO: 5811 - DNA, 21 bp, Artificial Sequence
  Synthetic construct
cgcagtcggaattcgtagcga

SEQ ID NO: 5812 - DNA, 21 bp, Artificial Sequence
  Synthetic construct
gcagtcggaattcgtagcgaa

SEQ ID NO: 5813 - DNA, 21 bp, Artificial Sequence
  Synthetic construct
cagtcggaattcgtagcgaaa

SEQ ID NO: 5814 - DNA, 21 bp, Artificial Sequence
  Synthetic construct
agtcggaattcgtagcgaaaa

SEQ ID NO: 5815 - DNA, 21 bp, Artificial Sequence
  Synthetic construct
gtcggaattcgtagcgaaaat

SEQ ID NO: 5816 - DNA, 21 bp, Artificial Sequence
  Synthetic construct
tcggaattcgtagcgaaaatt

SEQ ID NO: 5817 - DNA, 21 bp, Artificial Sequence
  Synthetic construct
cggaattcgtagcgaaaattg

SEQ ID NO: 5818 - DNA, 21 bp, Artificial Sequence
  Synthetic construct
ggaattcgtagcgaaaattgg

SEQ ID NO: 5819 - DNA, 21 bp, Artificial Sequence
  Synthetic construct
gaattcgtagcgaaaattgga

SEQ ID NO: 5820 - DNA, 21 bp, Artificial Sequence
  Synthetic construct
aattcgtagcgaaaattggaa

SEQ ID NO: 5821 - DNA, 21 bp, Artificial Sequence
  Synthetic construct
attcgtagcgaaaattggaat

SEQ ID NO: 5822 - DNA, 21 bp, Artificial Sequence
  Synthetic construct
ttcgtagcgaaaattggaatg

SEQ ID NO: 5823 - DNA, 21 bp, Artificial Sequence
  Synthetic construct
tcgtagcgaaaattggaatgg

SEQ ID NO: 5824 - DNA, 21 bp, Artificial Sequence
  Synthetic construct
cgtagcgaaaattggaatggt

SEQ ID NO: 5825 - DNA, 21 bp, Artificial Sequence
  Synthetic construct
gtagcgaaaattggaatggtt

SEQ ID NO: 5826 - DNA, 21 bp, Artificial Sequence
  Synthetic construct
tagcgaaaattggaatggtta

SEQ ID NO: 5827 - DNA, 21 bp, Artificial Sequence
  Synthetic construct
agcgaaaattggaatggttag

SEQ ID NO: 5828 - DNA, 21 bp, Artificial Sequence
  Synthetic construct
gcgaaaattggaatggttagt

SEQ ID NO: 5829 - DNA, 21 bp, Artificial Sequence
  Synthetic construct
cgaaaattggaatggttagtt

SEQ ID NO: 5830 - DNA, 21 bp, Artificial Sequence
  Synthetic construct
gaaaattggaatggttagttc

SEQ ID NO: 5831 - DNA, 21 bp, Artificial Sequence
  Synthetic construct
aaaattggaatggttagttcc

SEQ ID NO: 5832 - DNA, 21 bp, Artificial Sequence
  Synthetic construct
aaattggaatggttagttcca

SEQ ID NO: 5833 - DNA, 21 bp, Artificial Sequence
  Synthetic construct
aattggaatggttagttccat

SEQ ID NO: 5834 - DNA, 21 bp, Artificial Sequence
  Synthetic construct
attggaatggttagttccata

SEQ ID NO: 5835 - DNA, 21 bp, Artificial Sequence
  Synthetic construct
ttggaatggttagttccatat

SEQ ID NO: 5836 - DNA, 21 bp, Artificial Sequence
  Synthetic construct
tggaatggttagttccatatt

SEQ ID NO: 5837 - DNA, 21 bp, Artificial Sequence
  Synthetic construct
ggaatggttagttccatattt

SEQ ID NO: 5838 - DNA, 21 bp, Artificial Sequence
  Synthetic construct
gaatggttagttccatattta

SEQ ID NO: 5839 - DNA, 21 bp, Artificial Sequence
  Synthetic construct
aatggttagttccatatttaa

SEQ ID NO: 5840 - DNA, 21 bp, Artificial Sequence
  Synthetic construct
atggttagttccatatttaag

SEQ ID NO: 5841 - DNA, 21 bp, Artificial Sequence
  Synthetic construct
tggttagttccatatttaagt

SEQ ID NO: 5842 - DNA, 21 bp, Artificial Sequence
  Synthetic construct
ggttagttccatatttaagta

SEQ ID NO: 5843 - DNA, 21 bp, Artificial Sequence
  Synthetic construct
gttagttccatatttaagtac

SEQ ID NO: 5844 - DNA, 21 bp, Artificial Sequence
  Synthetic construct
ttagttccatatttaagtacg

SEQ ID NO: 5845 - DNA, 21 bp, Artificial Sequence
  Synthetic construct
tagttccatatttaagtacga

SEQ ID NO: 5846 - DNA, 21 bp, Artificial Sequence
  Synthetic construct
agttccatatttaagtacgaa

SEQ ID NO: 5847 - DNA, 21 bp, Artificial Sequence
  Synthetic construct
gttccatatttaagtacgaac

SEQ ID NO: 5848 - DNA, 21 bp, Artificial Sequence
  Synthetic construct
ttccatatttaagtacgaacg

SEQ ID NO: 5849 - DNA, 21 bp, Artificial Sequence
  Synthetic construct
tccatatttaagtacgaacgc

SEQ ID NO: 5850 - DNA, 21 bp, Artificial Sequence
  Synthetic construct
ccatatttaagtacgaacgcc

SEQ ID NO: 5851 - DNA, 21 bp, Artificial Sequence
  Synthetic construct
catatttaagtacgaacgcca

SEQ ID NO: 5852 - DNA, 21 bp, Artificial Sequence
  Synthetic construct
atatttaagtacgaacgccat

SEQ ID NO: 5853 - DNA, 21 bp, Artificial Sequence
  Synthetic construct
tatttaagtacgaacgccatg

SEQ ID NO: 5854 - DNA, 21 bp, Artificial Sequence
  Synthetic construct
atttaagtacgaacgccatgc

SEQ ID NO: 5855 - DNA, 21 bp, Artificial Sequence
  Synthetic construct
tttaagtacgaacgccatgcg

SEQ ID NO: 5856 - DNA, 21 bp, Artificial Sequence
  Synthetic construct
ttaagtacgaacgccatgcgg

SEQ ID NO: 5857 - DNA, 21 bp, Artificial Sequence
  Synthetic construct
taagtacgaacgccatgcggc

SEQ ID NO: 5858 - DNA, 21 bp, Artificial Sequence
  Synthetic construct
aagtacgaacgccatgcggct

SEQ ID NO: 5859 - DNA, 21 bp, Artificial Sequence
  Synthetic construct
agtacgaacgccatgcggcta

SEQ ID NO: 5860 - DNA, 21 bp, Artificial Sequence
  Synthetic construct
gtacgaacgccatgcggctac

SEQ ID NO: 5861 - DNA, 21 bp, Artificial Sequence
  Synthetic construct
tacgaacgccatgcggctaca

SEQ ID NO: 5862 - DNA, 21 bp, Artificial Sequence
  Synthetic construct
acgaacgccatgcggctacag

SEQ ID NO: 5863 - DNA, 21 bp, Artificial Sequence
  Synthetic construct
cgaacgccatgcggctacagg

SEQ ID NO: 5864 - DNA, 21 bp, Artificial Sequence
  Synthetic construct
gaacgccatgcggctacagga

SEQ ID NO: 5865 - DNA, 21 bp, Artificial Sequence
  Synthetic construct
aacgccatgcggctacaggaa

SEQ ID NO: 5866 - DNA, 21 bp, Artificial Sequence
  Synthetic construct
acgccatgcggctacaggaag

SEQ ID NO: 5867 - DNA, 21 bp, Artificial Sequence
  Synthetic construct
cgccatgcggctacaggaagc

SEQ ID NO: 5868 - DNA, 21 bp, Artificial Sequence
  Synthetic construct
gccatgcggctacaggaagct

SEQ ID NO: 5869 - DNA, 21 bp, Artificial Sequence
  Synthetic construct
ccatgcggctacaggaagctc

SEQ ID NO: 5870 - DNA, 21 bp, Artificial Sequence
  Synthetic construct
catgcggctacaggaagctct

SEQ ID NO: 5871 - DNA, 21 bp, Artificial Sequence
  Synthetic construct
atgcggctacaggaagctcta

SEQ ID NO: 5872 - DNA, 21 bp, Artificial Sequence
  Synthetic construct
tgcggctacaggaagctctac

SEQ ID NO: 5873 - DNA, 21 bp, Artificial Sequence
  Synthetic construct
gcggctacaggaagctctaca

SEQ ID NO: 5874 - DNA, 21 bp, Artificial Sequence
  Synthetic construct
cggctacaggaagctctacac

SEQ ID NO: 5875 - DNA, 21 bp, Artificial Sequence
  Synthetic construct
ggctacaggaagctctacacc

SEQ ID NO: 5876 - DNA, 21 bp, Artificial Sequence
  Synthetic construct
gctacaggaagctctacacca

SEQ ID NO: 5877 - DNA, 21 bp, Artificial Sequence
  Synthetic construct
ctacaggaagctctacaccac

SEQ ID NO: 5878 - DNA, 21 bp, Artificial Sequence
  Synthetic construct
tacaggaagctctacaccacc

SEQ ID NO: 5879 - DNA, 21 bp, Artificial Sequence
  Synthetic construct
acaggaagctctacaccacca

SEQ ID NO: 5880 - DNA, 21 bp, Artificial Sequence
  Synthetic construct
caggaagctctacaccaccaa

SEQ ID NO: 5881 - DNA, 21 bp, Artificial Sequence
  Synthetic construct
aggaagctctacaccaccaac

SEQ ID NO: 5882 - DNA, 21 bp, Artificial Sequence
  Synthetic construct
ggaagctctacaccaccaaca

SEQ ID NO: 5883 - DNA, 21 bp, Artificial Sequence
  Synthetic construct
gaagctctacaccaccaacag

SEQ ID NO: 5884 - DNA, 21 bp, Artificial Sequence
  Synthetic construct
aagctctacaccaccaacagt

SEQ ID NO: 5885 - DNA, 21 bp, Artificial Sequence
  Synthetic construct
agctctacaccaccaacagtc

SEQ ID NO: 5886 - DNA, 21 bp, Artificial Sequence
  Synthetic construct
gctctacaccaccaacagtct

SEQ ID NO: 5887 - DNA, 21 bp, Artificial Sequence
  Synthetic construct
ctctacaccaccaacagtctg

SEQ ID NO: 5888 - DNA, 21 bp, Artificial Sequence
  Synthetic construct
tctacaccaccaacagtctgg

SEQ ID NO: 5889 - DNA, 21 bp, Artificial Sequence
  Synthetic construct
ctacaccaccaacagtctggg

SEQ ID NO: 5890 - DNA, 21 bp, Artificial Sequence
  Synthetic construct
tacaccaccaacagtctgggt

SEQ ID NO: 5891 - DNA, 21 bp, Artificial Sequence
  Synthetic construct
acaccaccaacagtctgggtt

SEQ ID NO: 5892 - DNA, 21 bp, Artificial Sequence
  Synthetic construct
caccaccaacagtctgggttg

SEQ ID NO: 5893 - DNA, 21 bp, Artificial Sequence
  Synthetic construct
accaccaacagtctgggttgc

SEQ ID NO: 5894 - DNA, 21 bp, Artificial Sequence
  Synthetic construct
ccaccaacagtctgggttgcc

SEQ ID NO: 5895 - DNA, 21 bp, Artificial Sequence
  Synthetic construct
caccaacagtctgggttgcca

SEQ ID NO: 5896 - DNA, 21 bp, Artificial Sequence
  Synthetic construct
accaacagtctgggttgccac

SEQ ID NO: 5897 - DNA, 21 bp, Artificial Sequence
  Synthetic construct
ccaacagtctgggttgccact

SEQ ID NO: 5898 - DNA, 21 bp, Artificial Sequence
  Synthetic construct
caacagtctgggttgccactt

SEQ ID NO: 5899 - DNA, 21 bp, Artificial Sequence
  Synthetic construct
aacagtctgggttgccacttt

SEQ ID NO: 5900 - DNA, 21 bp, Artificial Sequence
  Synthetic construct
acagtctgggttgccacttta

SEQ ID NO: 5901 - DNA, 21 bp, Artificial Sequence
  Synthetic construct
cagtctgggttgccactttag

SEQ ID NO: 5902 - DNA, 21 bp, Artificial Sequence
  Synthetic construct
agtctgggttgccactttagg

SEQ ID NO: 5903 - DNA, 21 bp, Artificial Sequence
  Synthetic construct
gtctgggttgccactttaggc

SEQ ID NO: 5904 - DNA, 21 bp, Artificial Sequence
  Synthetic construct
tctgggttgccactttaggca

SEQ ID NO: 5905 - DNA, 21 bp, Artificial Sequence
  Synthetic construct
ctgggttgccactttaggcac

SEQ ID NO: 5906 - DNA, 21 bp, Artificial Sequence
  Synthetic construct
tgggttgccactttaggcacc

SEQ ID NO: 5907 - DNA, 21 bp, Artificial Sequence
  Synthetic construct
gggttgccactttaggcacct

SEQ ID NO: 5908 - DNA, 21 bp, Artificial Sequence
  Synthetic construct
ggttgccactttaggcacctc

SEQ ID NO: 5909 - DNA, 21 bp, Artificial Sequence
  Synthetic construct
gttgccactttaggcacctcg

SEQ ID NO: 5910 - DNA, 21 bp, Artificial Sequence
  Synthetic construct
ttgccactttaggcacctcga

SEQ ID NO: 5911 - DNA, 21 bp, Artificial Sequence
  Synthetic construct
tgccactttaggcacctcgac

SEQ ID NO: 5912 - DNA, 21 bp, Artificial Sequence
  Synthetic construct
gccactttaggcacctcgact

SEQ ID NO: 5913 - DNA, 21 bp, Artificial Sequence
  Synthetic construct
ccactttaggcacctcgactt

SEQ ID NO: 5914 - DNA, 21 bp, Artificial Sequence
  Synthetic construct
cactttaggcacctcgacttt

SEQ ID NO: 5915 - DNA, 21 bp, Artificial Sequence
  Synthetic construct
actttaggcacctcgactttg

SEQ ID NO: 5916 - DNA, 21 bp, Artificial Sequence
  Synthetic construct
ctttaggcacctcgactttga

SEQ ID NO: 5917 - DNA, 21 bp, Artificial Sequence
  Synthetic construct
tttaggcacctcgactttgat

SEQ ID NO: 5918 - DNA, 21 bp, Artificial Sequence
  Synthetic construct
ttaggcacctcgactttgatg

SEQ ID NO: 5919 - DNA, 21 bp, Artificial Sequence
  Synthetic construct
taggcacctcgactttgatgg

SEQ ID NO: 5920 - DNA, 21 bp, Artificial Sequence
  Synthetic construct
aggcacctcgactttgatggt

SEQ ID NO: 5921 - DNA, 21 bp, Artificial Sequence
  Synthetic construct
ggcacctcgactttgatggtg

SEQ ID NO: 5922 - DNA, 21 bp, Artificial Sequence
  Synthetic construct
gcacctcgactttgatggtgt

SEQ ID NO: 5923 - DNA, 21 bp, Artificial Sequence
  Synthetic construct
cacctcgactttgatggtgta

SEQ ID NO: 5924 - DNA, 21 bp, Artificial Sequence
  Synthetic construct
acctcgactttgatggtgtat

SEQ ID NO: 5925 - DNA, 21 bp, Artificial Sequence
  Synthetic construct
cctcgactttgatggtgtatt

SEQ ID NO: 5926 - DNA, 21 bp, Artificial Sequence
  Synthetic construct
ctcgactttgatggtgtattt

SEQ ID NO: 5927 - DNA, 21 bp, Artificial Sequence
  Synthetic construct
tcgactttgatggtgtatttg

SEQ ID NO: 5928 - DNA, 21 bp, Artificial Sequence
  Synthetic construct
cgactttgatggtgtatttgc

SEQ ID NO: 5929 - DNA, 21 bp, Artificial Sequence
  Synthetic construct
gactttgatggtgtatttgcg

SEQ ID NO: 5930 - DNA, 21 bp, Artificial Sequence
  Synthetic construct
actttgatggtgtatttgcga

SEQ ID NO: 5931 - DNA, 21 bp, Artificial Sequence
  Synthetic construct
ctttgatggtgtatttgcgat

SEQ ID NO: 5932 - DNA, 21 bp, Artificial Sequence
  Synthetic construct
tttgatggtgtatttgcgatt

SEQ ID NO: 5933 - DNA, 21 bp, Artificial Sequence
  Synthetic construct
ttgatggtgtatttgcgattc

SEQ ID NO: 5934 - DNA, 21 bp, Artificial Sequence
  Synthetic construct
tgatggtgtatttgcgattct

SEQ ID NO: 5935 - DNA, 21 bp, Artificial Sequence
  Synthetic construct
gatggtgtatttgcgattctg

SEQ ID NO: 5936 - DNA, 21 bp, Artificial Sequence
  Synthetic construct
atggtgtatttgcgattctgc

SEQ ID NO: 5937 - DNA, 21 bp, Artificial Sequence
  Synthetic construct
tggtgtatttgcgattctgcg

SEQ ID NO: 5938 - DNA, 21 bp, Artificial Sequence
  Synthetic construct
ggtgtatttgcgattctgcgc

SEQ ID NO: 5939 - DNA, 21 bp, Artificial Sequence
  Synthetic construct
gtgtatttgcgattctgcgca

SEQ ID NO: 5940 - DNA, 21 bp, Artificial Sequence
  Synthetic construct
tgtatttgcgattctgcgcag

SEQ ID NO: 5941 - DNA, 21 bp, Artificial Sequence
  Synthetic construct
gtatttgcgattctgcgcaga

SEQ ID NO: 5942 - DNA, 21 bp, Artificial Sequence
  Synthetic construct
tatttgcgattctgcgcagag

SEQ ID NO: 5943 - DNA, 21 bp, Artificial Sequence
  Synthetic construct
atttgcgattctgcgcagagc

SEQ ID NO: 5944 - DNA, 21 bp, Artificial Sequence
  Synthetic construct
tttgcgattctgcgcagagct

SEQ ID NO: 5945 - DNA, 21 bp, Artificial Sequence
  Synthetic construct
ttgcgattctgcgcagagctc

SEQ ID NO: 5946 - DNA, 21 bp, Artificial Sequence
  Synthetic construct
tgcgattctgcgcagagctct

SEQ ID NO: 5947 - DNA, 21 bp, Artificial Sequence
  Synthetic construct
gcgattctgcgcagagctctg

SEQ ID NO: 5948 - DNA, 21 bp, Artificial Sequence
  Synthetic construct
cgattctgcgcagagctctga

SEQ ID NO: 5949 - DNA, 21 bp, Artificial Sequence
  Synthetic construct
gattctgcgcagagctctgac

SEQ ID NO: 5950 - DNA, 21 bp, Artificial Sequence
  Synthetic construct
attctgcgcagagctctgacg

SEQ ID NO: 5951 - DNA, 21 bp, Artificial Sequence
  Synthetic construct
ttctgcgcagagctctgacga

SEQ ID NO: 5952 - DNA, 21 bp, Artificial Sequence
  Synthetic construct
tctgcgcagagctctgacgaa

SEQ ID NO: 5953 - DNA, 21 bp, Artificial Sequence
  Synthetic construct
ctgcgcagagctctgacgaac

SEQ ID NO: 5954 - DNA, 21 bp, Artificial Sequence
  Synthetic construct
tgcgcagagctctgacgaacg

SEQ ID NO: 5955 - DNA, 21 bp, Artificial Sequence
  Synthetic construct
gcgcagagctctgacgaacgc

SEQ ID NO: 5956 - DNA, 21 bp, Artificial Sequence
  Synthetic construct
cgcagagctctgacgaacgct

SEQ ID NO: 5957 - DNA, 21 bp, Artificial Sequence
  Synthetic construct
gcagagctctgacgaacgcta

SEQ ID NO: 5958 - DNA, 21 bp, Artificial Sequence
  Synthetic construct
cagagctctgacgaacgctac

SEQ ID NO: 5959 - DNA, 21 bp, Artificial Sequence
  Synthetic construct
agagctctgacgaacgctaca

SEQ ID NO: 5960 - DNA, 21 bp, Artificial Sequence
  Synthetic construct
gagctctgacgaacgctacag

SEQ ID NO: 5961 - DNA, 21 bp, Artificial Sequence
  Synthetic construct
agctctgacgaacgctacagg

SEQ ID NO: 5962 - DNA, 21 bp, Artificial Sequence
  Synthetic construct
gctctgacgaacgctacaggt

SEQ ID NO: 5963 - DNA, 21 bp, Artificial Sequence
  Synthetic construct
ctctgacgaacgctacaggtt

SEQ ID NO: 5964 - DNA, 21 bp, Artificial Sequence
  Synthetic construct
tctgacgaacgctacaggtta

SEQ ID NO: 5965 - DNA, 21 bp, Artificial Sequence
  Synthetic construct
ctgacgaacgctacaggttac

SEQ ID NO: 5966 - DNA, 21 bp, Artificial Sequence
  Synthetic construct
tgacgaacgctacaggttact

SEQ ID NO: 5967 - DNA, 21 bp, Artificial Sequence
  Synthetic construct
gacgaacgctacaggttactt

SEQ ID NO: 5968 - DNA, 21 bp, Artificial Sequence
  Synthetic construct
acgaacgctacaggttacttt

SEQ ID NO: 5969 - DNA, 21 bp, Artificial Sequence
  Synthetic construct
cgaacgctacaggttactttg

SEQ ID NO: 5970 - DNA, 21 bp, Artificial Sequence
  Synthetic construct
gaacgctacaggttactttgt

SEQ ID NO: 5971 - DNA, 21 bp, Artificial Sequence
  Synthetic construct
aacgctacaggttactttgta

SEQ ID NO: 5972 - DNA, 21 bp, Artificial Sequence
  Synthetic construct
acgctacaggttactttgtaa

SEQ ID NO: 5973 - DNA, 21 bp, Artificial Sequence
  Synthetic construct
cgctacaggttactttgtaag

SEQ ID NO: 5974 - DNA, 21 bp, Artificial Sequence
  Synthetic construct
gctacaggttactttgtaagc

SEQ ID NO: 5975 - DNA, 21 bp, Artificial Sequence
  Synthetic construct
ctacaggttactttgtaagcc

SEQ ID NO: 5976 - DNA, 21 bp, Artificial Sequence
  Synthetic construct
tacaggttactttgtaagcct

SEQ ID NO: 5977 - DNA, 21 bp, Artificial Sequence
  Synthetic construct
acaggttactttgtaagcctg

SEQ ID NO: 5978 - DNA, 21 bp, Artificial Sequence
  Synthetic construct
caggttactttgtaagcctgt

SEQ ID NO: 5979 - DNA, 21 bp, Artificial Sequence
  Synthetic construct
aggttactttgtaagcctgtg

SEQ ID NO: 5980 - DNA, 21 bp, Artificial Sequence
  Synthetic construct
ggttactttgtaagcctgtga

SEQ ID NO: 5981 - DNA, 21 bp, Artificial Sequence
  Synthetic construct
gttactttgtaagcctgtgaa

SEQ ID NO: 5982 - DNA, 21 bp, Artificial Sequence
  Synthetic construct
ttactttgtaagcctgtgaac

SEQ ID NO: 5983 - DNA, 21 bp, Artificial Sequence
  Synthetic construct
tactttgtaagcctgtgaacg

SEQ ID NO: 5984 - DNA, 21 bp, Artificial Sequence
  Synthetic construct
actttgtaagcctgtgaacgc

SEQ ID NO: 5985 - DNA, 21 bp, Artificial Sequence
  Synthetic construct
ctttgtaagcctgtgaacgcg

SEQ ID NO: 5986 - DNA, 21 bp, Artificial Sequence
  Synthetic construct
tttgtaagcctgtgaacgcga

SEQ ID NO: 5987 - DNA, 21 bp, Artificial Sequence
  Synthetic construct
ttgtaagcctgtgaacgcgag

SEQ ID NO: 5988 - DNA, 21 bp, Artificial Sequence
  Synthetic construct
tgtaagcctgtgaacgcgagt

SEQ ID NO: 5989 - DNA, 21 bp, Artificial Sequence
  Synthetic construct
gtaagcctgtgaacgcgagtt

SEQ ID NO: 5990 - DNA, 21 bp, Artificial Sequence
  Synthetic construct
taagcctgtgaacgcgagtta

SEQ ID NO: 5991 - DNA, 21 bp, Artificial Sequence
  Synthetic construct
aagcctgtgaacgcgagttag

SEQ ID NO: 5992 - DNA, 21 bp, Artificial Sequence
  Synthetic construct
agcctgtgaacgcgagttaga

SEQ ID NO: 5993 - DNA, 21 bp, Artificial Sequence
  Synthetic construct
gcctgtgaacgcgagttagag

SEQ ID NO: 5994 - DNA, 21 bp, Artificial Sequence
  Synthetic construct
cctgtgaacgcgagttagagc

SEQ ID NO: 5995 - DNA, 21 bp, Artificial Sequence
  Synthetic construct
ctgtgaacgcgagttagagct

SEQ ID NO: 5996 - DNA, 21 bp, Artificial Sequence
  Synthetic construct
tgtgaacgcgagttagagctg

SEQ ID NO: 5997 - DNA, 21 bp, Artificial Sequence
  Synthetic construct
gtgaacgcgagttagagctga

SEQ ID NO: 5998 - DNA, 21 bp, Artificial Sequence
  Synthetic construct
tgaacgcgagttagagctgat

SEQ ID NO: 5999 - DNA, 21 bp, Artificial Sequence
  Synthetic construct
gaacgcgagttagagctgatc

SEQ ID NO: 6000 - DNA, 21 bp, Artificial Sequence
  Synthetic construct
aacgcgagttagagctgatcc

SEQ ID NO: 6001 - DNA, 21 bp, Artificial Sequence
  Synthetic construct
acgcgagttagagctgatcca

SEQ ID NO: 6002 - DNA, 21 bp, Artificial Sequence
  Synthetic construct
cgcgagttagagctgatccat

SEQ ID NO: 6003 - DNA, 21 bp, Artificial Sequence
  Synthetic construct
gcgagttagagctgatccatt

SEQ ID NO: 6004 - DNA, 21 bp, Artificial Sequence
  Synthetic construct
cgagttagagctgatccattc

SEQ ID NO: 6005 - DNA, 21 bp, Artificial Sequence
  Synthetic construct
gagttagagctgatccattca

SEQ ID NO: 6006 - DNA, 21 bp, Artificial Sequence
  Synthetic construct
agttagagctgatccattcag

SEQ ID NO: 6007 - DNA, 21 bp, Artificial Sequence
  Synthetic construct
gttagagctgatccattcagc

SEQ ID NO: 6008 - DNA, 21 bp, Artificial Sequence
  Synthetic construct
ttagagctgatccattcagcg

SEQ ID NO: 6009 - DNA, 21 bp, Artificial Sequence
  Synthetic construct
tagagctgatccattcagcga

SEQ ID NO: 6010 - DNA, 21 bp, Artificial Sequence
  Synthetic construct
agagctgatccattcagcgac

SEQ ID NO: 6011 - DNA, 21 bp, Artificial Sequence
  Synthetic construct
gagctgatccattcagcgacc

SEQ ID NO: 6012 - DNA, 21 bp, Artificial Sequence
  Synthetic construct
agctgatccattcagcgaccc

SEQ ID NO: 6013 - DNA, 21 bp, Artificial Sequence
  Synthetic construct
gctgatccattcagcgacccc

SEQ ID NO: 6014 - DNA, 21 bp, Artificial Sequence
  Synthetic construct
ctgatccattcagcgaccccg

SEQ ID NO: 6015 - DNA, 21 bp, Artificial Sequence
  Synthetic construct
tgatccattcagcgaccccgt

SEQ ID NO: 6016 - DNA, 21 bp, Artificial Sequence
  Synthetic construct
gatccattcagcgaccccgtt

SEQ ID NO: 6017 - DNA, 21 bp, Artificial Sequence
  Synthetic construct
atccattcagcgaccccgtta

SEQ ID NO: 6018 - DNA, 21 bp, Artificial Sequence
  Synthetic construct
tccattcagcgaccccgttag

SEQ ID NO: 6019 - DNA, 21 bp, Artificial Sequence
  Synthetic construct
ccattcagcgaccccgttagc

SEQ ID NO: 6020 - DNA, 21 bp, Artificial Sequence
  Synthetic construct
cattcagcgaccccgttagcg

SEQ ID NO: 6021 - DNA, 21 bp, Artificial Sequence
  Synthetic construct
attcagcgaccccgttagcga

SEQ ID NO: 6022 - DNA, 21 bp, Artificial Sequence
  Synthetic construct
ttcagcgaccccgttagcgaa

SEQ ID NO: 6023 - DNA, 21 bp, Artificial Sequence
  Synthetic construct
tcagcgaccccgttagcgaag

SEQ ID NO: 6024 - DNA, 21 bp, Artificial Sequence
  Synthetic construct
cagcgaccccgttagcgaagt

SEQ ID NO: 6025 - DNA, 21 bp, Artificial Sequence
  Synthetic construct
agcgaccccgttagcgaagtt

SEQ ID NO: 6026 - DNA, 21 bp, Artificial Sequence
  Synthetic construct
gcgaccccgttagcgaagttg

SEQ ID NO: 6027 - DNA, 21 bp, Artificial Sequence
  Synthetic construct
cgaccccgttagcgaagttgc

SEQ ID NO: 6028 - DNA, 21 bp, Artificial Sequence
  Synthetic construct
gaccccgttagcgaagttgct

SEQ ID NO: 6029 - DNA, 21 bp, Artificial Sequence
  Synthetic construct
accccgttagcgaagttgctt

SEQ ID NO: 6030 - DNA, 21 bp, Artificial Sequence
  Synthetic construct
ccccgttagcgaagttgcttg

SEQ ID NO: 6031 - DNA, 21 bp, Artificial Sequence
  Synthetic construct
cccgttagcgaagttgcttgg

SEQ ID NO: 6032 - DNA, 21 bp, Artificial Sequence
  Synthetic construct
ccgttagcgaagttgcttggg

SEQ ID NO: 6033 - DNA, 21 bp, Artificial Sequence
  Synthetic construct
cgttagcgaagttgcttgggg

SEQ ID NO: 6034 - DNA, 21 bp, Artificial Sequence
  Synthetic construct
gttagcgaagttgcttggggc

SEQ ID NO: 6035 - DNA, 21 bp, Artificial Sequence
  Synthetic construct
ttagcgaagttgcttggggcg

SEQ ID NO: 6036 - DNA, 21 bp, Artificial Sequence
  Synthetic construct
tagcgaagttgcttggggcga

SEQ ID NO: 6037 - DNA, 21 bp, Artificial Sequence
  Synthetic construct
agcgaagttgcttggggcgac

SEQ ID NO: 6038 - DNA, 21 bp, Artificial Sequence
  Synthetic construct
gcgaagttgcttggggcgaca

SEQ ID NO: 6039 - DNA, 21 bp, Artificial Sequence
  Synthetic construct
cgaagttgcttggggcgacag

SEQ ID NO: 6040 - DNA, 21 bp, Artificial Sequence
  Synthetic construct
gaagttgcttggggcgacagt

SEQ ID NO: 6041 - DNA, 21 bp, Artificial Sequence
  Synthetic construct
aagttgcttggggcgacagtc

SEQ ID NO: 6042 - DNA, 21 bp, Artificial Sequence
  Synthetic construct
agttgcttggggcgacagtca

SEQ ID NO: 6043 - DNA, 21 bp, Artificial Sequence
  Synthetic construct
gttgcttggggcgacagtcac

SEQ ID NO: 6044 - DNA, 21 bp, Artificial Sequence
  Synthetic construct
ttgcttggggcgacagtcacg

SEQ ID NO: 6045 - DNA, 21 bp, Artificial Sequence
  Synthetic construct
tgcttggggcgacagtcacgt

SEQ ID NO: 6046 - DNA, 21 bp, Artificial Sequence
  Synthetic construct
gcttggggcgacagtcacgtc

SEQ ID NO: 6047 - DNA, 21 bp, Artificial Sequence
  Synthetic construct
cttggggcgacagtcacgtcg

SEQ ID NO: 6048 - DNA, 21 bp, Artificial Sequence
  Synthetic construct
ttggggcgacagtcacgtcgc

SEQ ID NO: 6049 - DNA, 21 bp, Artificial Sequence
  Synthetic construct
tggggcgacagtcacgtcgcc

SEQ ID NO: 6050 - DNA, 21 bp, Artificial Sequence
  Synthetic construct
ggggcgacagtcacgtcgcca

SEQ ID NO: 6051 - DNA, 21 bp, Artificial Sequence
  Synthetic construct
gggcgacagtcacgtcgccag

SEQ ID NO: 6052 - DNA, 21 bp, Artificial Sequence
  Synthetic construct
ggcgacagtcacgtcgccagt

SEQ ID NO: 6053 - DNA, 21 bp, Artificial Sequence
  Synthetic construct
gcgacagtcacgtcgccagtt

SEQ ID NO: 6054 - DNA, 21 bp, Artificial Sequence
  Synthetic construct
cgacagtcacgtcgccagttc

SEQ ID NO: 6055 - DNA, 21 bp, Artificial Sequence
  Synthetic construct
gacagtcacgtcgccagttcc

SEQ ID NO: 6056 - DNA, 21 bp, Artificial Sequence
  Synthetic construct
acagtcacgtcgccagttccg

SEQ ID NO: 6057 - DNA, 21 bp, Artificial Sequence
  Synthetic construct
cagtcacgtcgccagttccgc

SEQ ID NO: 6058 - DNA, 21 bp, Artificial Sequence
  Synthetic construct
agtcacgtcgccagttccgcc

SEQ ID NO: 6059 - DNA, 21 bp, Artificial Sequence
  Synthetic construct
gtcacgtcgccagttccgcca

SEQ ID NO: 6060 - DNA, 21 bp, Artificial Sequence
  Synthetic construct
tcacgtcgccagttccgccat

SEQ ID NO: 6061 - DNA, 21 bp, Artificial Sequence
  Synthetic construct
cacgtcgccagttccgccatt

SEQ ID NO: 6062 - DNA, 21 bp, Artificial Sequence
  Synthetic construct
acgtcgccagttccgccattg

SEQ ID NO: 6063 - DNA, 21 bp, Artificial Sequence
  Synthetic construct
cgtcgccagttccgccattgt

SEQ ID NO: 6064 - DNA, 21 bp, Artificial Sequence
  Synthetic construct
gtcgccagttccgccattgtc

SEQ ID NO: 6065 - DNA, 21 bp, Artificial Sequence
  Synthetic construct
tcgccagttccgccattgtcg

SEQ ID NO: 6066 - DNA, 21 bp, Artificial Sequence
  Synthetic construct
cgccagttccgccattgtcga

SEQ ID NO: 6067 - DNA, 21 bp, Artificial Sequence
  Synthetic construct
gccagttccgccattgtcgac

SEQ ID NO: 6068 - DNA, 21 bp, Artificial Sequence
  Synthetic construct
ccagttccgccattgtcgacg

SEQ ID NO: 6069 - DNA, 21 bp, Artificial Sequence
  Synthetic construct
cagttccgccattgtcgacga

SEQ ID NO: 6070 - DNA, 21 bp, Artificial Sequence
  Synthetic construct
agttccgccattgtcgacgag

SEQ ID NO: 6071 - DNA, 21 bp, Artificial Sequence
  Synthetic construct
gttccgccattgtcgacgaga

SEQ ID NO: 6072 - DNA, 21 bp, Artificial Sequence
  Synthetic construct
ttccgccattgtcgacgagaa

SEQ ID NO: 6073 - DNA, 21 bp, Artificial Sequence
  Synthetic construct
tccgccattgtcgacgagaac

SEQ ID NO: 6074 - DNA, 21 bp, Artificial Sequence
  Synthetic construct
ccgccattgtcgacgagaacg

SEQ ID NO: 6075 - DNA, 21 bp, Artificial Sequence
  Synthetic construct
cgccattgtcgacgagaacga

SEQ ID NO: 6076 - DNA, 21 bp, Artificial Sequence
  Synthetic construct
gccattgtcgacgagaacgaa

SEQ ID NO: 6077 - DNA, 21 bp, Artificial Sequence
  Synthetic construct
ccattgtcgacgagaacgaac

SEQ ID NO: 6078 - DNA, 21 bp, Artificial Sequence
  Synthetic construct
cattgtcgacgagaacgaact

SEQ ID NO: 6079 - DNA, 21 bp, Artificial Sequence
  Synthetic construct
attgtcgacgagaacgaactg

SEQ ID NO: 6080 - DNA, 21 bp, Artificial Sequence
  Synthetic construct
ttgtcgacgagaacgaactga

SEQ ID NO: 6081 - DNA, 21 bp, Artificial Sequence
  Synthetic construct
tgtcgacgagaacgaactgag

SEQ ID NO: 6082 - DNA, 21 bp, Artificial Sequence
  Synthetic construct
gtcgacgagaacgaactgagt

SEQ ID NO: 6083 - DNA, 21 bp, Artificial Sequence
  Synthetic construct
tcgacgagaacgaactgagta

SEQ ID NO: 6084 - DNA, 21 bp, Artificial Sequence
  Synthetic construct
cgacgagaacgaactgagtaa

SEQ ID NO: 6085 - DNA, 21 bp, Artificial Sequence
  Synthetic construct
gacgagaacgaactgagtaaa

SEQ ID NO: 6086 - DNA, 21 bp, Artificial Sequence
  Synthetic construct
acgagaacgaactgagtaaag

SEQ ID NO: 6087 - DNA, 21 bp, Artificial Sequence
  Synthetic construct
cgagaacgaactgagtaaagt

SEQ ID NO: 6088 - DNA, 21 bp, Artificial Sequence
  Synthetic construct
gagaacgaactgagtaaagtt

SEQ ID NO: 6089 - DNA, 21 bp, Artificial Sequence
  Synthetic construct
agaacgaactgagtaaagtta

SEQ ID NO: 6090 - DNA, 21 bp, Artificial Sequence
  Synthetic construct
gaacgaactgagtaaagttag

SEQ ID NO: 6091 - DNA, 21 bp, Artificial Sequence
  Synthetic construct
aacgaactgagtaaagttaga

SEQ ID NO: 6092 - DNA, 21 bp, Artificial Sequence
  Synthetic construct
acgaactgagtaaagttagaa

SEQ ID NO: 6093 - DNA, 21 bp, Artificial Sequence
  Synthetic construct
cgaactgagtaaagttagaag

SEQ ID NO: 6094 - DNA, 21 bp, Artificial Sequence
  Synthetic construct
gaactgagtaaagttagaagc

SEQ ID NO: 6095 - DNA, 21 bp, Artificial Sequence
  Synthetic construct
aactgagtaaagttagaagcc

SEQ ID NO: 6096 - DNA, 21 bp, Artificial Sequence
  Synthetic construct
actgagtaaagttagaagcca

SEQ ID NO: 6097 - DNA, 21 bp, Artificial Sequence
  Synthetic construct
ctgagtaaagttagaagccat

SEQ ID NO: 6098 - DNA, 21 bp, Artificial Sequence
  Synthetic construct
tgagtaaagttagaagccatg

SEQ ID NO: 6099 - DNA, 21 bp, Artificial Sequence
  Synthetic construct
gagtaaagttagaagccatgc

SEQ ID NO: 6100 - DNA, 21 bp, Artificial Sequence
  Synthetic construct
agtaaagttagaagccatgct

SEQ ID NO: 6101 - DNA, 21 bp, Artificial Sequence
  Synthetic construct
gtaaagttagaagccatgctt

SEQ ID NO: 6102 - DNA, 21 bp, Artificial Sequence
  Synthetic construct
taaagttagaagccatgcttc

SEQ ID NO: 6103 - DNA, 21 bp, Artificial Sequence
  Synthetic construct
aaagttagaagccatgcttca

SEQ ID NO: 6104 - DNA, 21 bp, Artificial Sequence
  Synthetic construct
aagttagaagccatgcttcaa

SEQ ID NO: 6105 - DNA, 21 bp, Artificial Sequence
  Synthetic construct
agttagaagccatgcttcaaa

SEQ ID NO: 6106 - DNA, 21 bp, Artificial Sequence
  Synthetic construct
gttagaagccatgcttcaaac

SEQ ID NO: 6107 - DNA, 21 bp, Artificial Sequence
  Synthetic construct
ttagaagccatgcttcaaact

SEQ ID NO: 6108 - DNA, 21 bp, Artificial Sequence
  Synthetic construct
tagaagccatgcttcaaactc

SEQ ID NO: 6109 - DNA, 21 bp, Artificial Sequence
  Synthetic construct
agaagccatgcttcaaactcc

SEQ ID NO: 6110 - DNA, 21 bp, Artificial Sequence
  Synthetic construct
gaagccatgcttcaaactccg

SEQ ID NO: 6111 - DNA, 21 bp, Artificial Sequence
  Synthetic construct
aagccatgcttcaaactccgg

SEQ ID NO: 6112 - DNA, 21 bp, Artificial Sequence
  Synthetic construct
agccatgcttcaaactccggt

SEQ ID NO: 6113 - DNA, 21 bp, Artificial Sequence
  Synthetic construct
gccatgcttcaaactccggtt

SEQ ID NO: 6114 - DNA, 21 bp, Artificial Sequence
  Synthetic construct
ccatgcttcaaactccggttg

SEQ ID NO: 6115 - DNA, 21 bp, Artificial Sequence
  Synthetic construct
catgcttcaaactccggttga

SEQ ID NO: 6116 - DNA, 21 bp, Artificial Sequence
  Synthetic construct
atgcttcaaactccggttgag

SEQ ID NO: 6117 - DNA, 21 bp, Artificial Sequence
  Synthetic construct
tgcttcaaactccggttgagg

SEQ ID NO: 6118 - DNA, 21 bp, Artificial Sequence
  Synthetic construct
gcttcaaactccggttgaggg

SEQ ID NO: 6119 - DNA, 21 bp, Artificial Sequence
  Synthetic construct
cttcaaactccggttgagggc

SEQ ID NO: 6120 - DNA, 21 bp, Artificial Sequence
  Synthetic construct
ttcaaactccggttgagggct

SEQ ID NO: 6121 - DNA, 21 bp, Artificial Sequence
  Synthetic construct
tcaaactccggttgagggctc

SEQ ID NO: 6122 - DNA, 21 bp, Artificial Sequence
  Synthetic construct
caaactccggttgagggctct

SEQ ID NO: 6123 - DNA, 21 bp, Artificial Sequence
  Synthetic construct
aaactccggttgagggctcta

SEQ ID NO: 6124 - DNA, 21 bp, Artificial Sequence
  Synthetic construct
aactccggttgagggctctat

SEQ ID NO: 6125 - DNA, 21 bp, Artificial Sequence
  Synthetic construct
actccggttgagggctctatc

SEQ ID NO: 6126 - DNA, 21 bp, Artificial Sequence
  Synthetic construct
ctccggttgagggctctatct

SEQ ID NO: 6127 - DNA, 21 bp, Artificial Sequence
  Synthetic construct
tccggttgagggctctatcta

SEQ ID NO: 6128 - DNA, 21 bp, Artificial Sequence
  Synthetic construct
ccggttgagggctctatctag

SEQ ID NO: 6129 - DNA, 21 bp, Artificial Sequence
  Synthetic construct
cggttgagggctctatctaga

SEQ ID NO: 6130 - DNA, 21 bp, Artificial Sequence
  Synthetic construct
ggttgagggctctatctagag

SEQ ID NO: 6131 - DNA, 21 bp, Artificial Sequence
  Synthetic construct
gttgagggctctatctagaga

SEQ ID NO: 6132 - DNA, 21 bp, Artificial Sequence
  Synthetic construct
ttgagggctctatctagagag

SEQ ID NO: 6133 - DNA, 21 bp, Artificial Sequence
  Synthetic construct
tgagggctctatctagagagc

SEQ ID NO: 6134 - DNA, 21 bp, Artificial Sequence
  Synthetic construct
gagggctctatctagagagcc

SEQ ID NO: 6135 - DNA, 21 bp, Artificial Sequence
  Synthetic construct
agggctctatctagagagccg

SEQ ID NO: 6136 - DNA, 21 bp, Artificial Sequence
  Synthetic construct
gggctctatctagagagccgt

SEQ ID NO: 6137 - DNA, 21 bp, Artificial Sequence
  Synthetic construct
ggctctatctagagagccgtt

SEQ ID NO: 6138 - DNA, 21 bp, Artificial Sequence
  Synthetic construct
gctctatctagagagccgttg

SEQ ID NO: 6139 - DNA, 21 bp, Artificial Sequence
  Synthetic construct
ctctatctagagagccgttgc

SEQ ID NO: 6140 - DNA, 21 bp, Artificial Sequence
  Synthetic construct
tctatctagagagccgttgcc

SEQ ID NO: 6141 - DNA, 21 bp, Artificial Sequence
  Synthetic construct
ctatctagagagccgttgcct

SEQ ID NO: 6142 - DNA, 21 bp, Artificial Sequence
  Synthetic construct
tatctagagagccgttgcctg

SEQ ID NO: 6143 - DNA, 21 bp, Artificial Sequence
  Synthetic construct
atctagagagccgttgcctga

SEQ ID NO: 6144 - DNA, 21 bp, Artificial Sequence
  Synthetic construct
tctagagagccgttgcctgat

SEQ ID NO: 6145 - DNA, 21 bp, Artificial Sequence
  Synthetic construct
ctagagagccgttgcctgatt

SEQ ID NO: 6146 - DNA, 21 bp, Artificial Sequence
  Synthetic construct
tagagagccgttgcctgatta

SEQ ID NO: 6147 - DNA, 21 bp, Artificial Sequence
  Synthetic construct
agagagccgttgcctgattaa

SEQ ID NO: 6148 - DNA, 21 bp, Artificial Sequence
  Synthetic construct
gagagccgttgcctgattaat

SEQ ID NO: 6149 - DNA, 21 bp, Artificial Sequence
  Synthetic construct
agagccgttgcctgattaatg

SEQ ID NO: 6150 - DNA, 21 bp, Artificial Sequence
  Synthetic construct
gagccgttgcctgattaatgc

SEQ ID NO: 6151 - DNA, 21 bp, Artificial Sequence
  Synthetic construct
agccgttgcctgattaatgct

SEQ ID NO: 6152 - DNA, 21 bp, Artificial Sequence
  Synthetic construct
gccgttgcctgattaatgcta

SEQ ID NO: 6153 - DNA, 21 bp, Artificial Sequence
  Synthetic construct
ccgttgcctgattaatgctaa

SEQ ID NO: 6154 - DNA, 21 bp, Artificial Sequence
  Synthetic construct
cgttgcctgattaatgctaac

SEQ ID NO: 6155 - DNA, 21 bp, Artificial Sequence
  Synthetic construct
gttgcctgattaatgctaacg

SEQ ID NO: 6156 - DNA, 21 bp, Artificial Sequence
  Synthetic construct
ttgcctgattaatgctaacgc

SEQ ID NO: 6157 - DNA, 21 bp, Artificial Sequence
  Synthetic construct
tgcctgattaatgctaacgca

SEQ ID NO: 6158 - DNA, 21 bp, Artificial Sequence
  Synthetic construct
gcctgattaatgctaacgcat

SEQ ID NO: 6159 - DNA, 21 bp, Artificial Sequence
  Synthetic construct
cctgattaatgctaacgcatc

SEQ ID NO: 6160 - DNA, 21 bp, Artificial Sequence
  Synthetic construct
ctgattaatgctaacgcatct

SEQ ID NO: 6161 - DNA, 21 bp, Artificial Sequence
  Synthetic construct
tgattaatgctaacgcatcta

SEQ ID NO: 6162 - DNA, 21 bp, Artificial Sequence
  Synthetic construct
gattaatgctaacgcatctaa

SEQ ID NO: 6163 - DNA, 21 bp, Artificial Sequence
  Synthetic construct
attaatgctaacgcatctaag

SEQ ID NO: 6164 - DNA, 21 bp, Artificial Sequence
  Synthetic construct
ttaatgctaacgcatctaagg

SEQ ID NO: 6165 - DNA, 21 bp, Artificial Sequence
  Synthetic construct
taatgctaacgcatctaaggt

SEQ ID NO: 6166 - DNA, 21 bp, Artificial Sequence
  Synthetic construct
aatgctaacgcatctaaggta

SEQ ID NO: 6167 - DNA, 21 bp, Artificial Sequence
  Synthetic construct
atgctaacgcatctaaggtat

SEQ ID NO: 6168 - DNA, 21 bp, Artificial Sequence
  Synthetic construct
tgctaacgcatctaaggtatg

SEQ ID NO: 6169 - DNA, 21 bp, Artificial Sequence
  Synthetic construct
gctaacgcatctaaggtatgg

SEQ ID NO: 6170 - DNA, 21 bp, Artificial Sequence
  Synthetic construct
ctaacgcatctaaggtatgga

SEQ ID NO: 6171 - DNA, 21 bp, Artificial Sequence
  Synthetic construct
taacgcatctaaggtatggac

SEQ ID NO: 6172 - DNA, 21 bp, Artificial Sequence
  Synthetic construct
aacgcatctaaggtatggacc

SEQ ID NO: 6173 - DNA, 21 bp, Artificial Sequence
  Synthetic construct
acgcatctaaggtatggacca

SEQ ID NO: 6174 - DNA, 21 bp, Artificial Sequence
  Synthetic construct
cgcatctaaggtatggaccat

SEQ ID NO: 6175 - DNA, 21 bp, Artificial Sequence
  Synthetic construct
gcatctaaggtatggaccatc

SEQ ID NO: 6176 - DNA, 21 bp, Artificial Sequence
  Synthetic construct
catctaaggtatggaccatcg

SEQ ID NO: 6177 - DNA, 21 bp, Artificial Sequence
  Synthetic construct
atctaaggtatggaccatcga

SEQ ID NO: 6178 - DNA, 21 bp, Artificial Sequence
  Synthetic construct
tctaaggtatggaccatcgag

SEQ ID NO: 6179 - DNA, 21 bp, Artificial Sequence
  Synthetic construct
ctaaggtatggaccatcgaga

SEQ ID NO: 6180 - DNA, 21 bp, Artificial Sequence
  Synthetic construct
taaggtatggaccatcgagaa

SEQ ID NO: 6181 - DNA, 21 bp, Artificial Sequence
  Synthetic construct
aaggtatggaccatcgagaaa

SEQ ID NO: 6182 - DNA, 21 bp, Artificial Sequence
  Synthetic construct
aggtatggaccatcgagaaag

SEQ ID NO: 6183 - DNA, 21 bp, Artificial Sequence
  Synthetic construct
ggtatggaccatcgagaaagg

SEQ ID NO: 6184 - DNA, 21 bp, Artificial Sequence
  Synthetic construct
gtatggaccatcgagaaagga

SEQ ID NO: 6185 - DNA, 21 bp, Artificial Sequence
  Synthetic construct
tatggaccatcgagaaaggag

SEQ ID NO: 6186 - DNA, 21 bp, Artificial Sequence
  Synthetic construct
atggaccatcgagaaaggaga

SEQ ID NO: 6187 - DNA, 21 bp, Artificial Sequence
  Synthetic construct
tggaccatcgagaaaggagac

SEQ ID NO: 6188 - DNA, 21 bp, Artificial Sequence
  Synthetic construct
ggaccatcgagaaaggagact

SEQ ID NO: 6189 - DNA, 21 bp, Artificial Sequence
  Synthetic construct
gaccatcgagaaaggagactt

SEQ ID NO: 6190 - DNA, 21 bp, Artificial Sequence
  Synthetic construct
accatcgagaaaggagacttt

SEQ ID NO: 6191 - DNA, 21 bp, Artificial Sequence
  Synthetic construct
ccatcgagaaaggagacttta

SEQ ID NO: 6192 - DNA, 21 bp, Artificial Sequence
  Synthetic construct
catcgagaaaggagactttac

SEQ ID NO: 6193 - DNA, 21 bp, Artificial Sequence
  Synthetic construct
atcgagaaaggagactttacg

SEQ ID NO: 6194 - DNA, 21 bp, Artificial Sequence
  Synthetic construct
tcgagaaaggagactttacgt

SEQ ID NO: 6195 - DNA, 21 bp, Artificial Sequence
  Synthetic construct
cgagaaaggagactttacgta

SEQ ID NO: 6196 - DNA, 21 bp, Artificial Sequence
  Synthetic construct
gagaaaggagactttacgtac

SEQ ID NO: 6197 - DNA, 21 bp, Artificial Sequence
  Synthetic construct
agaaaggagactttacgtacg

SEQ ID NO: 6198 - DNA, 21 bp, Artificial Sequence
  Synthetic construct
gaaaggagactttacgtacgc

SEQ ID NO: 6199 - DNA, 21 bp, Artificial Sequence
  Synthetic construct
aaaggagactttacgtacgcg

SEQ ID NO: 6200 - DNA, 21 bp, Artificial Sequence
  Synthetic construct
aaggagactttacgtacgcgc

SEQ ID NO: 6201 - DNA, 21 bp, Artificial Sequence
  Synthetic construct
aggagactttacgtacgcgcc

SEQ ID NO: 6202 - DNA, 21 bp, Artificial Sequence
  Synthetic construct
ggagactttacgtacgcgcca

SEQ ID NO: 6203 - DNA, 21 bp, Artificial Sequence
  Synthetic construct
gagactttacgtacgcgccag

SEQ ID NO: 6204 - DNA, 21 bp, Artificial Sequence
  Synthetic construct
agactttacgtacgcgccagt

SEQ ID NO: 6205 - DNA, 21 bp, Artificial Sequence
  Synthetic construct
gactttacgtacgcgccagtt

SEQ ID NO: 6206 - DNA, 21 bp, Artificial Sequence
  Synthetic construct
actttacgtacgcgccagttg

SEQ ID NO: 6207 - DNA, 21 bp, Artificial Sequence
  Synthetic construct
ctttacgtacgcgccagttgt

SEQ ID NO: 6208 - DNA, 21 bp, Artificial Sequence
  Synthetic construct
tttacgtacgcgccagttgtt

SEQ ID NO: 6209 - DNA, 21 bp, Artificial Sequence
  Synthetic construct
ttacgtacgcgccagttgttg

SEQ ID NO: 6210 - DNA, 21 bp, Artificial Sequence
  Synthetic construct
tacgtacgcgccagttgttgg

SEQ ID NO: 6211 - DNA, 21 bp, Artificial Sequence
  Synthetic construct
acgtacgcgccagttgttggc

SEQ ID NO: 6212 - DNA, 21 bp, Artificial Sequence
  Synthetic construct
cgtacgcgccagttgttggcc

SEQ ID NO: 6213 - DNA, 21 bp, Artificial Sequence
  Synthetic construct
gtacgcgccagttgttggcca

SEQ ID NO: 6214 - DNA, 21 bp, Artificial Sequence
  Synthetic construct
tacgcgccagttgttggccat

SEQ ID NO: 6215 - DNA, 21 bp, Artificial Sequence
  Synthetic construct
acgcgccagttgttggccata

SEQ ID NO: 6216 - DNA, 21 bp, Artificial Sequence
  Synthetic construct
cgcgccagttgttggccatac

SEQ ID NO: 6217 - DNA, 21 bp, Artificial Sequence
  Synthetic construct
gcgccagttgttggccatacg

SEQ ID NO: 6218 - DNA, 21 bp, Artificial Sequence
  Synthetic construct
cgccagttgttggccatacgg

SEQ ID NO: 6219 - DNA, 21 bp, Artificial Sequence
  Synthetic construct
gccagttgttggccatacgga

SEQ ID NO: 6220 - DNA, 21 bp, Artificial Sequence
  Synthetic construct
ccagttgttggccatacggat

SEQ ID NO: 6221 - DNA, 21 bp, Artificial Sequence
  Synthetic construct
cagttgttggccatacggatt

SEQ ID NO: 6222 - DNA, 21 bp, Artificial Sequence
  Synthetic construct
agttgttggccatacggattg

SEQ ID NO: 6223 - DNA, 21 bp, Artificial Sequence
  Synthetic construct
gttgttggccatacggattgt

SEQ ID NO: 6224 - DNA, 21 bp, Artificial Sequence
  Synthetic construct
ttgttggccatacggattgta

SEQ ID NO: 6225 - DNA, 21 bp, Artificial Sequence
  Synthetic construct
tgttggccatacggattgtac

SEQ ID NO: 6226 - DNA, 21 bp, Artificial Sequence
  Synthetic construct
gttggccatacggattgtacc

SEQ ID NO: 6227 - DNA, 21 bp, Artificial Sequence
  Synthetic construct
ttggccatacggattgtaccc

SEQ ID NO: 6228 - DNA, 21 bp, Artificial Sequence
  Synthetic construct
tggccatacggattgtacccc

SEQ ID NO: 6229 - DNA, 21 bp, Artificial Sequence
  Synthetic construct
ggccatacggattgtacccct

SEQ ID NO: 6230 - DNA, 21 bp, Artificial Sequence
  Synthetic construct
gccatacggattgtacccctc

SEQ ID NO: 6231 - DNA, 21 bp, Artificial Sequence
  Synthetic construct
ccatacggattgtacccctcg

SEQ ID NO: 6232 - DNA, 21 bp, Artificial Sequence
  Synthetic construct
catacggattgtacccctcga

SEQ ID NO: 6233 - DNA, 21 bp, Artificial Sequence
  Synthetic construct
atacggattgtacccctcgat

SEQ ID NO: 6234 - DNA, 21 bp, Artificial Sequence
  Synthetic construct
tacggattgtacccctcgatg

SEQ ID NO: 6235 - DNA, 21 bp, Artificial Sequence
  Synthetic construct
acggattgtacccctcgatgc

SEQ ID NO: 6236 - DNA, 21 bp, Artificial Sequence
  Synthetic construct
cggattgtacccctcgatgca

SEQ ID NO: 6237 - DNA, 21 bp, Artificial Sequence
  Synthetic construct
ggattgtacccctcgatgcat

SEQ ID NO: 6238 - DNA, 21 bp, Artificial Sequence
  Synthetic construct
gattgtacccctcgatgcatg

SEQ ID NO: 6239 - DNA, 21 bp, Artificial Sequence
  Synthetic construct
attgtacccctcgatgcatgg

SEQ ID NO: 6240 - DNA, 21 bp, Artificial Sequence
  Synthetic construct
ttgtacccctcgatgcatggc

SEQ ID NO: 6241 - DNA, 21 bp, Artificial Sequence
  Synthetic construct
tgtacccctcgatgcatggct

SEQ ID NO: 6242 - DNA, 21 bp, Artificial Sequence
  Synthetic construct
gtacccctcgatgcatggctg

SEQ ID NO: 6243 - DNA, 21 bp, Artificial Sequence
  Synthetic construct
tacccctcgatgcatggctga

SEQ ID NO: 6244 - DNA, 21 bp, Artificial Sequence
  Synthetic construct
acccctcgatgcatggctgag

SEQ ID NO: 6245 - DNA, 21 bp, Artificial Sequence
  Synthetic construct
cccctcgatgcatggctgaga

SEQ ID NO: 6246 - DNA, 21 bp, Artificial Sequence
  Synthetic construct
ccctcgatgcatggctgagat

SEQ ID NO: 6247 - DNA, 21 bp, Artificial Sequence
  Synthetic construct
cctcgatgcatggctgagatt

SEQ ID NO: 6248 - DNA, 21 bp, Artificial Sequence
  Synthetic construct
ctcgatgcatggctgagattt

SEQ ID NO: 6249 - DNA, 21 bp, Artificial Sequence
  Synthetic construct
tcgatgcatggctgagatttg

SEQ ID NO: 6250 - DNA, 21 bp, Artificial Sequence
  Synthetic construct
cgatgcatggctgagatttgg

SEQ ID NO: 6251 - DNA, 21 bp, Artificial Sequence
  Synthetic construct
gatgcatggctgagatttggg

SEQ ID NO: 6252 - DNA, 21 bp, Artificial Sequence
  Synthetic construct
atgcatggctgagatttgggc

SEQ ID NO: 6253 - DNA, 21 bp, Artificial Sequence
  Synthetic construct
tgcatggctgagatttgggcc

SEQ ID NO: 6254 - DNA, 21 bp, Artificial Sequence
  Synthetic construct
gcatggctgagatttgggcct

SEQ ID NO: 6255 - DNA, 21 bp, Artificial Sequence
  Synthetic construct
catggctgagatttgggcctt

SEQ ID NO: 6256 - DNA, 21 bp, Artificial Sequence
  Synthetic construct
atggctgagatttgggcctta

SEQ ID NO: 6257 - DNA, 21 bp, Artificial Sequence
  Synthetic construct
tggctgagatttgggccttag

SEQ ID NO: 6258 - DNA, 21 bp, Artificial Sequence
  Synthetic construct
ggctgagatttgggccttagc

SEQ ID NO: 6259 - DNA, 21 bp, Artificial Sequence
  Synthetic construct
gctgagatttgggccttagca

SEQ ID NO: 6260 - DNA, 21 bp, Artificial Sequence
  Synthetic construct
ctgagatttgggccttagcag

SEQ ID NO: 6261 - DNA, 21 bp, Artificial Sequence
  Synthetic construct
tgagatttgggccttagcagt

SEQ ID NO: 6262 - DNA, 21 bp, Artificial Sequence
  Synthetic construct
gagatttgggccttagcagtg

SEQ ID NO: 6263 - DNA, 21 bp, Artificial Sequence
  Synthetic construct
agatttgggccttagcagtgc

SEQ ID NO: 6264 - DNA, 21 bp, Artificial Sequence
  Synthetic construct
gatttgggccttagcagtgcc

SEQ ID NO: 6265 - DNA, 21 bp, Artificial Sequence
  Synthetic construct
atttgggccttagcagtgccc

SEQ ID NO: 6266 - DNA, 21 bp, Artificial Sequence
  Synthetic construct
tttgggccttagcagtgccct

SEQ ID NO: 6267 - DNA, 21 bp, Artificial Sequence
  Synthetic construct
ttgggccttagcagtgccctg

SEQ ID NO: 6268 - DNA, 21 bp, Artificial Sequence
  Synthetic construct
tgggccttagcagtgccctgt

SEQ ID NO: 6269 - DNA, 21 bp, Artificial Sequence
  Synthetic construct
gggccttagcagtgccctgtc

SEQ ID NO: 6270 - DNA, 21 bp, Artificial Sequence
  Synthetic construct
ggccttagcagtgccctgtct

SEQ ID NO: 6271 - DNA, 21 bp, Artificial Sequence
  Synthetic construct
gccttagcagtgccctgtctc

SEQ ID NO: 6272 - DNA, 21 bp, Artificial Sequence
  Synthetic construct
ccttagcagtgccctgtctct

SEQ ID NO: 6273 - DNA, 21 bp, Artificial Sequence
  Synthetic construct
cttagcagtgccctgtctctc

SEQ ID NO: 6274 - DNA, 21 bp, Artificial Sequence
  Synthetic construct
ttagcagtgccctgtctctcc

SEQ ID NO: 6275 - DNA, 21 bp, Artificial Sequence
  Synthetic construct
tagcagtgccctgtctctcca

SEQ ID NO: 6276 - DNA, 21 bp, Artificial Sequence
  Synthetic construct
agcagtgccctgtctctccac

SEQ ID NO: 6277 - DNA, 21 bp, Artificial Sequence
  Synthetic construct
gcagtgccctgtctctccaca

SEQ ID NO: 6278 - DNA, 21 bp, Artificial Sequence
  Synthetic construct
cagtgccctgtctctccacag

SEQ ID NO: 6279 - DNA, 21 bp, Artificial Sequence
  Synthetic construct
agtgccctgtctctccacagt

SEQ ID NO: 6280 - DNA, 21 bp, Artificial Sequence
  Synthetic construct
gtgccctgtctctccacagtc

SEQ ID NO: 6281 - DNA, 21 bp, Artificial Sequence
  Synthetic construct
tgccctgtctctccacagtcc

SEQ ID NO: 6282 - DNA, 21 bp, Artificial Sequence
  Synthetic construct
gccctgtctctccacagtcca

SEQ ID NO: 6283 - DNA, 21 bp, Artificial Sequence
  Synthetic construct
ccctgtctctccacagtccac

SEQ ID NO: 6284 - DNA, 21 bp, Artificial Sequence
  Synthetic construct
cctgtctctccacagtccacc

SEQ ID NO: 6285 - DNA, 21 bp, Artificial Sequence
  Synthetic construct
ctgtctctccacagtccaccc

SEQ ID NO: 6286 - DNA, 21 bp, Artificial Sequence
  Synthetic construct
tgtctctccacagtccacccg

SEQ ID NO: 6287 - DNA, 21 bp, Artificial Sequence
  Synthetic construct
gtctctccacagtccacccgt

SEQ ID NO: 6288 - DNA, 21 bp, Artificial Sequence
  Synthetic construct
tctctccacagtccacccgta

SEQ ID NO: 6289 - DNA, 21 bp, Artificial Sequence
  Synthetic construct
ctctccacagtccacccgtag

SEQ ID NO: 6290 - DNA, 21 bp, Artificial Sequence
  Synthetic construct
tctccacagtccacccgtagg

SEQ ID NO: 6291 - DNA, 21 bp, Artificial Sequence
  Synthetic construct
ctccacagtccacccgtaggg

SEQ ID NO: 6292 - DNA, 21 bp, Artificial Sequence
  Synthetic construct
tccacagtccacccgtaggga

SEQ ID NO: 6293 - DNA, 21 bp, Artificial Sequence
  Synthetic construct
ccacagtccacccgtagggag

SEQ ID NO: 6294 - DNA, 21 bp, Artificial Sequence
  Synthetic construct
cacagtccacccgtagggagc

SEQ ID NO: 6295 - DNA, 21 bp, Artificial Sequence
  Synthetic construct
acagtccacccgtagggagcg

SEQ ID NO: 6296 - DNA, 21 bp, Artificial Sequence
  Synthetic construct
cagtccacccgtagggagcgt

SEQ ID NO: 6297 - DNA, 21 bp, Artificial Sequence
  Synthetic construct
agtccacccgtagggagcgtc

SEQ ID NO: 6298 - DNA, 21 bp, Artificial Sequence
  Synthetic construct
gtccacccgtagggagcgtca

SEQ ID NO: 6299 - DNA, 21 bp, Artificial Sequence
  Synthetic construct
tccacccgtagggagcgtcaa

SEQ ID NO: 6300 - DNA, 21 bp, Artificial Sequence
  Synthetic construct
ccacccgtagggagcgtcaac

SEQ ID NO: 6301 - DNA, 21 bp, Artificial Sequence
  Synthetic construct
cacccgtagggagcgtcaacg

SEQ ID NO: 6302 - DNA, 21 bp, Artificial Sequence
  Synthetic construct
acccgtagggagcgtcaacgc

SEQ ID NO: 6303 - DNA, 21 bp, Artificial Sequence
  Synthetic construct
cccgtagggagcgtcaacgct

SEQ ID NO: 6304 - DNA, 21 bp, Artificial Sequence
  Synthetic construct
ccgtagggagcgtcaacgctt

SEQ ID NO: 6305 - DNA, 21 bp, Artificial Sequence
  Synthetic construct
cgtagggagcgtcaacgctta

SEQ ID NO: 6306 - DNA, 21 bp, Artificial Sequence
  Synthetic construct
gtagggagcgtcaacgcttat

SEQ ID NO: 6307 - DNA, 21 bp, Artificial Sequence
  Synthetic construct
tagggagcgtcaacgcttatg

SEQ ID NO: 6308 - DNA, 21 bp, Artificial Sequence
  Synthetic construct
agggagcgtcaacgcttatga

SEQ ID NO: 6309 - DNA, 21 bp, Artificial Sequence
  Synthetic construct
gggagcgtcaacgcttatgat

SEQ ID NO: 6310 - DNA, 21 bp, Artificial Sequence
  Synthetic construct
ggagcgtcaacgcttatgatg

SEQ ID NO: 6311 - DNA, 21 bp, Artificial Sequence
  Synthetic construct
gagcgtcaacgcttatgatgg

SEQ ID NO: 6312 - DNA, 21 bp, Artificial Sequence
  Synthetic construct
agcgtcaacgcttatgatgga

SEQ ID NO: 6313 - DNA, 21 bp, Artificial Sequence
  Synthetic construct
gcgtcaacgcttatgatggac

SEQ ID NO: 6314 - DNA, 21 bp, Artificial Sequence
  Synthetic construct
cgtcaacgcttatgatggact

SEQ ID NO: 6315 - DNA, 21 bp, Artificial Sequence
  Synthetic construct
gtcaacgcttatgatggactc

SEQ ID NO: 6316 - DNA, 21 bp, Artificial Sequence
  Synthetic construct
tcaacgcttatgatggactca

SEQ ID NO: 6317 - DNA, 21 bp, Artificial Sequence
  Synthetic construct
caacgcttatgatggactcac

SEQ ID NO: 6318 - DNA, 21 bp, Artificial Sequence
  Synthetic construct
aacgcttatgatggactcacc

SEQ ID NO: 6319 - DNA, 21 bp, Artificial Sequence
  Synthetic construct
acgcttatgatggactcaccc

SEQ ID NO: 6320 - DNA, 21 bp, Artificial Sequence
  Synthetic construct
cgcttatgatggactcacccg

SEQ ID NO: 6321 - DNA, 21 bp, Artificial Sequence
  Synthetic construct
gcttatgatggactcacccgt

SEQ ID NO: 6322 - DNA, 21 bp, Artificial Sequence
  Synthetic construct
cttatgatggactcacccgtt

SEQ ID NO: 6323 - DNA, 21 bp, Artificial Sequence
  Synthetic construct
ttatgatggactcacccgtta

SEQ ID NO: 6324 - DNA, 21 bp, Artificial Sequence
  Synthetic construct
tatgatggactcacccgttat

SEQ ID NO: 6325 - DNA, 21 bp, Artificial Sequence
  Synthetic construct
atgatggactcacccgttatt

SEQ ID NO: 6326 - DNA, 21 bp, Artificial Sequence
  Synthetic construct
tgatggactcacccgttatta

SEQ ID NO: 6327 - DNA, 21 bp, Artificial Sequence
  Synthetic construct
gatggactcacccgttattac

SEQ ID NO: 6328 - DNA, 21 bp, Artificial Sequence
  Synthetic construct
atggactcacccgttattacg

SEQ ID NO: 6329 - DNA, 21 bp, Artificial Sequence
  Synthetic construct
tggactcacccgttattacgt

SEQ ID NO: 6330 - DNA, 21 bp, Artificial Sequence
  Synthetic construct
ggactcacccgttattacgtc

SEQ ID NO: 6331 - DNA, 21 bp, Artificial Sequence
  Synthetic construct
gactcacccgttattacgtca

SEQ ID NO: 6332 - DNA, 21 bp, Artificial Sequence
  Synthetic construct
actcacccgttattacgtcag

SEQ ID NO: 6333 - DNA, 21 bp, Artificial Sequence
  Synthetic construct
ctcacccgttattacgtcagt

SEQ ID NO: 6334 - DNA, 21 bp, Artificial Sequence
  Synthetic construct
tcacccgttattacgtcagta

SEQ ID NO: 6335 - DNA, 21 bp, Artificial Sequence
  Synthetic construct
cacccgttattacgtcagtaa

SEQ ID NO: 6336 - DNA, 21 bp, Artificial Sequence
  Synthetic construct
acccgttattacgtcagtaac

SEQ ID NO: 6337 - DNA, 21 bp, Artificial Sequence
  Synthetic construct
cccgttattacgtcagtaact

SEQ ID NO: 6338 - DNA, 21 bp, Artificial Sequence
  Synthetic construct
ccgttattacgtcagtaactg

SEQ ID NO: 6339 - DNA, 21 bp, Artificial Sequence
  Synthetic construct
cgttattacgtcagtaactgt

SEQ ID NO: 6340 - DNA, 21 bp, Artificial Sequence
  Synthetic construct
gttattacgtcagtaactgtt

SEQ ID NO: 6341 - DNA, 21 bp, Artificial Sequence
  Synthetic construct
ttattacgtcagtaactgttc

SEQ ID NO: 6342 - DNA, 21 bp, Artificial Sequence
  Synthetic construct
tattacgtcagtaactgttcc

SEQ ID NO: 6343 - DNA, 21 bp, Artificial Sequence
  Synthetic construct
attacgtcagtaactgttcct

SEQ ID NO: 6344 - DNA, 21 bp, Artificial Sequence
  Synthetic construct
ttacgtcagtaactgttcctg

SEQ ID NO: 6345 - DNA, 21 bp, Artificial Sequence
  Synthetic construct
tacgtcagtaactgttcctga

SEQ ID NO: 6346 - DNA, 21 bp, Artificial Sequence
  Synthetic construct
acgtcagtaactgttcctgac

SEQ ID NO: 6347 - DNA, 21 bp, Artificial Sequence
  Synthetic construct
cgtcagtaactgttcctgaca

SEQ ID NO: 6348 - DNA, 21 bp, Artificial Sequence
  Synthetic construct
gtcagtaactgttcctgacat

SEQ ID NO: 6349 - DNA, 21 bp, Artificial Sequence
  Synthetic construct
tcagtaactgttcctgacatg

SEQ ID NO: 6350 - DNA, 21 bp, Artificial Sequence
  Synthetic construct
cagtaactgttcctgacatgt

SEQ ID NO: 6351 - DNA, 21 bp, Artificial Sequence
  Synthetic construct
agtaactgttcctgacatgta

SEQ ID NO: 6352 - DNA, 21 bp, Artificial Sequence
  Synthetic construct
gtaactgttcctgacatgtag

SEQ ID NO: 6353 - DNA, 21 bp, Artificial Sequence
  Synthetic construct
taactgttcctgacatgtagg

SEQ ID NO: 6354 - DNA, 21 bp, Artificial Sequence
  Synthetic construct
aactgttcctgacatgtagga

SEQ ID NO: 6355 - DNA, 21 bp, Artificial Sequence
  Synthetic construct
actgttcctgacatgtaggag

SEQ ID NO: 6356 - DNA, 21 bp, Artificial Sequence
  Synthetic construct
ctgttcctgacatgtaggagc

SEQ ID NO: 6357 - DNA, 21 bp, Artificial Sequence
  Synthetic construct
tgttcctgacatgtaggagca

SEQ ID NO: 6358 - DNA, 21 bp, Artificial Sequence
  Synthetic construct
gttcctgacatgtaggagcat

SEQ ID NO: 6359 - DNA, 21 bp, Artificial Sequence
  Synthetic construct
ttcctgacatgtaggagcatc

SEQ ID NO: 6360 - DNA, 21 bp, Artificial Sequence
  Synthetic construct
tcctgacatgtaggagcatcc

SEQ ID NO: 6361 - DNA, 21 bp, Artificial Sequence
  Synthetic construct
cctgacatgtaggagcatccc

SEQ ID NO: 6362 - DNA, 21 bp, Artificial Sequence
  Synthetic construct
ctgacatgtaggagcatccca

SEQ ID NO: 6363 - DNA, 21 bp, Artificial Sequence
  Synthetic construct
tgacatgtaggagcatcccac

SEQ ID NO: 6364 - DNA, 21 bp, Artificial Sequence
  Synthetic construct
gacatgtaggagcatcccacg

SEQ ID NO: 6365 - DNA, 21 bp, Artificial Sequence
  Synthetic construct
acatgtaggagcatcccacgg

SEQ ID NO: 6366 - DNA, 21 bp, Artificial Sequence
  Synthetic construct
catgtaggagcatcccacggg

SEQ ID NO: 6367 - DNA, 21 bp, Artificial Sequence
  Synthetic construct
atgtaggagcatcccacgggg

SEQ ID NO: 6368 - DNA, 21 bp, Artificial Sequence
  Synthetic construct
tgtaggagcatcccacggggg

SEQ ID NO: 6369 - DNA, 21 bp, Artificial Sequence
  Synthetic construct
gtaggagcatcccacgggggc

SEQ ID NO: 6370 - DNA, 21 bp, Artificial Sequence
  Synthetic construct
taggagcatcccacgggggcc

SEQ ID NO: 6371 - DNA, 21 bp, Artificial Sequence
  Synthetic construct
aggagcatcccacgggggccg

SEQ ID NO: 6372 - DNA, 21 bp, Artificial Sequence
  Synthetic construct
ggagcatcccacgggggccgt

SEQ ID NO: 6373 - DNA, 21 bp, Artificial Sequence
  Synthetic construct
gagcatcccacgggggccgta

SEQ ID NO: 6374 - DNA, 21 bp, Artificial Sequence
  Synthetic construct
agcatcccacgggggccgtaa

SEQ ID NO: 6375 - DNA, 21 bp, Artificial Sequence
  Synthetic construct
gcatcccacgggggccgtaag

SEQ ID NO: 6376 - DNA, 21 bp, Artificial Sequence
  Synthetic construct
catcccacgggggccgtaagg

SEQ ID NO: 6377 - DNA, 21 bp, Artificial Sequence
  Synthetic construct
atcccacgggggccgtaaggc

SEQ ID NO: 6378 - DNA, 21 bp, Artificial Sequence
  Synthetic construct
tcccacgggggccgtaaggcc

SEQ ID NO: 6379 - DNA, 21 bp, Artificial Sequence
  Synthetic construct
cccacgggggccgtaaggccc

SEQ ID NO: 6380 - DNA, 21 bp, Artificial Sequence
  Synthetic construct
ccacgggggccgtaaggccct

SEQ ID NO: 6381 - DNA, 21 bp, Artificial Sequence
  Synthetic construct
cacgggggccgtaaggccctc

SEQ ID NO: 6382 - DNA, 21 bp, Artificial Sequence
  Synthetic construct
acgggggccgtaaggccctcg

SEQ ID NO: 6383 - DNA, 21 bp, Artificial Sequence
  Synthetic construct
cgggggccgtaaggccctcga

SEQ ID NO: 6384 - DNA, 21 bp, Artificial Sequence
  Synthetic construct
gggggccgtaaggccctcgag

SEQ ID NO: 6385 - DNA, 21 bp, Artificial Sequence
  Synthetic construct
ggggccgtaaggccctcgagc

SEQ ID NO: 6386 - DNA, 21 bp, Artificial Sequence
  Synthetic construct
gggccgtaaggccctcgagca

SEQ ID NO: 6387 - DNA, 21 bp, Artificial Sequence
  Synthetic construct
ggccgtaaggccctcgagcat

SEQ ID NO: 6388 - DNA, 21 bp, Artificial Sequence
  Synthetic construct
gccgtaaggccctcgagcatg

SEQ ID NO: 6389 - DNA, 21 bp, Artificial Sequence
  Synthetic construct
ccgtaaggccctcgagcatgt

SEQ ID NO: 6390 - DNA, 21 bp, Artificial Sequence
  Synthetic construct
cgtaaggccctcgagcatgtt

SEQ ID NO: 6391 - DNA, 21 bp, Artificial Sequence
  Synthetic construct
gtaaggccctcgagcatgtta

SEQ ID NO: 6392 - DNA, 21 bp, Artificial Sequence
  Synthetic construct
taaggccctcgagcatgttac

SEQ ID NO: 6393 - DNA, 21 bp, Artificial Sequence
  Synthetic construct
aaggccctcgagcatgttacc

SEQ ID NO: 6394 - DNA, 21 bp, Artificial Sequence
  Synthetic construct
aggccctcgagcatgttacct

SEQ ID NO: 6395 - DNA, 21 bp, Artificial Sequence
  Synthetic construct
ggccctcgagcatgttaccta

SEQ ID NO: 6396 - DNA, 21 bp, Artificial Sequence
  Synthetic construct
gccctcgagcatgttacctac

SEQ ID NO: 6397 - DNA, 21 bp, Artificial Sequence
  Synthetic construct
ccctcgagcatgttacctaca

SEQ ID NO: 6398 - DNA, 21 bp, Artificial Sequence
  Synthetic construct
cctcgagcatgttacctacag

SEQ ID NO: 6399 - DNA, 21 bp, Artificial Sequence
  Synthetic construct
ctcgagcatgttacctacagg

SEQ ID NO: 6400 - DNA, 21 bp, Artificial Sequence
  Synthetic construct
tcgagcatgttacctacaggt

SEQ ID NO: 6401 - DNA, 21 bp, Artificial Sequence
  Synthetic construct
cgagcatgttacctacaggta

SEQ ID NO: 6402 - DNA, 21 bp, Artificial Sequence
  Synthetic construct
gagcatgttacctacaggtag

SEQ ID NO: 6403 - DNA, 21 bp, Artificial Sequence
  Synthetic construct
agcatgttacctacaggtagg

SEQ ID NO: 6404 - DNA, 21 bp, Artificial Sequence
  Synthetic construct
gcatgttacctacaggtagga

SEQ ID NO: 6405 - DNA, 21 bp, Artificial Sequence
  Synthetic construct
catgttacctacaggtaggag

SEQ ID NO: 6406 - DNA, 21 bp, Artificial Sequence
  Synthetic construct
atgttacctacaggtaggagc

SEQ ID NO: 6407 - DNA, 21 bp, Artificial Sequence
  Synthetic construct
tgttacctacaggtaggagcc

SEQ ID NO: 6408 - DNA, 21 bp, Artificial Sequence
  Synthetic construct
gttacctacaggtaggagcca

SEQ ID NO: 6409 - DNA, 21 bp, Artificial Sequence
  Synthetic construct
ttacctacaggtaggagccag

SEQ ID NO: 6410 - DNA, 21 bp, Artificial Sequence
  Synthetic construct
tacctacaggtaggagccagt

SEQ ID NO: 6411 - DNA, 21 bp, Artificial Sequence
  Synthetic construct
acctacaggtaggagccagtc

SEQ ID NO: 6412 - DNA, 21 bp, Artificial Sequence
  Synthetic construct
cctacaggtaggagccagtcg

SEQ ID NO: 6413 - DNA, 21 bp, Artificial Sequence
  Synthetic construct
ctacaggtaggagccagtcga

SEQ ID NO: 6414 - DNA, 21 bp, Artificial Sequence
  Synthetic construct
tacaggtaggagccagtcgac

SEQ ID NO: 6415 - DNA, 21 bp, Artificial Sequence
  Synthetic construct
acaggtaggagccagtcgaca

SEQ ID NO: 6416 - DNA, 21 bp, Artificial Sequence
  Synthetic construct
caggtaggagccagtcgacaa

SEQ ID NO: 6417 - DNA, 21 bp, Artificial Sequence
  Synthetic construct
aggtaggagccagtcgacaac

SEQ ID NO: 6418 - DNA, 21 bp, Artificial Sequence
  Synthetic construct
ggtaggagccagtcgacaacg

SEQ ID NO: 6419 - DNA, 21 bp, Artificial Sequence
  Synthetic construct
gtaggagccagtcgacaacga

SEQ ID NO: 6420 - DNA, 21 bp, Artificial Sequence
  Synthetic construct
taggagccagtcgacaacgaa

SEQ ID NO: 6421 - DNA, 21 bp, Artificial Sequence
  Synthetic construct
aggagccagtcgacaacgaat

SEQ ID NO: 6422 - DNA, 21 bp, Artificial Sequence
  Synthetic construct
ggagccagtcgacaacgaatg

SEQ ID NO: 6423 - DNA, 21 bp, Artificial Sequence
  Synthetic construct
gagccagtcgacaacgaatga

SEQ ID NO: 6424 - DNA, 21 bp, Artificial Sequence
  Synthetic construct
agccagtcgacaacgaatgag

SEQ ID NO: 6425 - DNA, 21 bp, Artificial Sequence
  Synthetic construct
gccagtcgacaacgaatgaga

SEQ ID NO: 6426 - DNA, 21 bp, Artificial Sequence
  Synthetic construct
ccagtcgacaacgaatgagaa

SEQ ID NO: 6427 - DNA, 21 bp, Artificial Sequence
  Synthetic construct
cagtcgacaacgaatgagaaa

SEQ ID NO: 6428 - DNA, 21 bp, Artificial Sequence
  Synthetic construct
agtcgacaacgaatgagaaag

SEQ ID NO: 6429 - DNA, 21 bp, Artificial Sequence
  Synthetic construct
gtcgacaacgaatgagaaagg

SEQ ID NO: 6430 - DNA, 21 bp, Artificial Sequence
  Synthetic construct
tcgacaacgaatgagaaaggc

SEQ ID NO: 6431 - DNA, 21 bp, Artificial Sequence
  Synthetic construct
cgacaacgaatgagaaaggca

SEQ ID NO: 6432 - DNA, 21 bp, Artificial Sequence
  Synthetic construct
gacaacgaatgagaaaggcac

SEQ ID NO: 6433 - DNA, 21 bp, Artificial Sequence
  Synthetic construct
acaacgaatgagaaaggcacc

SEQ ID NO: 6434 - DNA, 21 bp, Artificial Sequence
  Synthetic construct
caacgaatgagaaaggcacct

SEQ ID NO: 6435 - DNA, 21 bp, Artificial Sequence
  Synthetic construct
aacgaatgagaaaggcacctt

SEQ ID NO: 6436 - DNA, 21 bp, Artificial Sequence
  Synthetic construct
acgaatgagaaaggcaccttt

SEQ ID NO: 6437 - DNA, 21 bp, Artificial Sequence
  Synthetic construct
cgaatgagaaaggcacctttt

SEQ ID NO: 6438 - DNA, 21 bp, Artificial Sequence
  Synthetic construct
gaatgagaaaggcaccttttc

SEQ ID NO: 6439 - DNA, 21 bp, Artificial Sequence
  Synthetic construct
aatgagaaaggcaccttttcc

SEQ ID NO: 6440 - DNA, 21 bp, Artificial Sequence
  Synthetic construct
atgagaaaggcaccttttccc

SEQ ID NO: 6441 - DNA, 21 bp, Artificial Sequence
  Synthetic construct
tgagaaaggcaccttttccca

SEQ ID NO: 6442 - DNA, 21 bp, Artificial Sequence
  Synthetic construct
gagaaaggcaccttttcccac

SEQ ID NO: 6443 - DNA, 21 bp, Artificial Sequence
  Synthetic construct
agaaaggcaccttttcccaca

SEQ ID NO: 6444 - DNA, 21 bp, Artificial Sequence
  Synthetic construct
gaaaggcaccttttcccacac

SEQ ID NO: 6445 - DNA, 21 bp, Artificial Sequence
  Synthetic construct
aaaggcaccttttcccacact

SEQ ID NO: 6446 - DNA, 21 bp, Artificial Sequence
  Synthetic construct
aaggcaccttttcccacacta

SEQ ID NO: 6447 - DNA, 21 bp, Artificial Sequence
  Synthetic construct
aggcaccttttcccacactat

SEQ ID NO: 6448 - DNA, 21 bp, Artificial Sequence
  Synthetic construct
ggcaccttttcccacactata

SEQ ID NO: 6449 - DNA, 21 bp, Artificial Sequence
  Synthetic construct
gcaccttttcccacactatac

SEQ ID NO: 6450 - DNA, 21 bp, Artificial Sequence
  Synthetic construct
caccttttcccacactatacc

SEQ ID NO: 6451 - DNA, 21 bp, Artificial Sequence
  Synthetic construct
accttttcccacactatacct

SEQ ID NO: 6452 - DNA, 21 bp, Artificial Sequence
  Synthetic construct
ccttttcccacactataccta

SEQ ID NO: 6453 - DNA, 21 bp, Artificial Sequence
  Synthetic construct
cttttcccacactatacctag

SEQ ID NO: 6454 - DNA, 21 bp, Artificial Sequence
  Synthetic construct
ttttcccacactatacctagt

SEQ ID NO: 6455 - DNA, 21 bp, Artificial Sequence
  Synthetic construct
tttcccacactatacctagtg

SEQ ID NO: 6456 - DNA, 21 bp, Artificial Sequence
  Synthetic construct
ttcccacactatacctagtgg

SEQ ID NO: 6457 - DNA, 21 bp, Artificial Sequence
  Synthetic construct
tcccacactatacctagtggg

SEQ ID NO: 6458 - DNA, 21 bp, Artificial Sequence
  Synthetic construct
cccacactatacctagtgggt

SEQ ID NO: 6459 - DNA, 21 bp, Artificial Sequence
  Synthetic construct
ccacactatacctagtgggtt

SEQ ID NO: 6460 - DNA, 21 bp, Artificial Sequence
  Synthetic construct
cacactatacctagtgggttc

SEQ ID NO: 6461 - DNA, 21 bp, Artificial Sequence
  Synthetic construct
acactatacctagtgggttca

SEQ ID NO: 6462 - DNA, 21 bp, Artificial Sequence
  Synthetic construct
cactatacctagtgggttcaa

SEQ ID NO: 6463 - DNA, 21 bp, Artificial Sequence
  Synthetic construct
actatacctagtgggttcaag

SEQ ID NO: 6464 - DNA, 21 bp, Artificial Sequence
  Synthetic construct
ctatacctagtgggttcaaga

SEQ ID NO: 6465 - DNA, 21 bp, Artificial Sequence
  Synthetic construct
tatacctagtgggttcaagat

SEQ ID NO: 6466 - DNA, 21 bp, Artificial Sequence
  Synthetic construct
atacctagtgggttcaagata

SEQ ID NO: 6467 - DNA, 21 bp, Artificial Sequence
  Synthetic construct
tacctagtgggttcaagatac

SEQ ID NO: 6468 - DNA, 21 bp, Artificial Sequence
  Synthetic construct
acctagtgggttcaagatacc

SEQ ID NO: 6469 - DNA, 21 bp, Artificial Sequence
  Synthetic construct
cctagtgggttcaagatacct

SEQ ID NO: 6470 - DNA, 21 bp, Artificial Sequence
  Synthetic construct
ctagtgggttcaagataccta

SEQ ID NO: 6471 - DNA, 21 bp, Artificial Sequence
  Synthetic construct
tagtgggttcaagatacctag

SEQ ID NO: 6472 - DNA, 21 bp, Artificial Sequence
  Synthetic construct
agtgggttcaagatacctaga

SEQ ID NO: 6473 - DNA, 21 bp, Artificial Sequence
  Synthetic construct
gtgggttcaagatacctagag

SEQ ID NO: 6474 - DNA, 21 bp, Artificial Sequence
  Synthetic construct
tgggttcaagatacctagaga

SEQ ID NO: 6475 - DNA, 21 bp, Artificial Sequence
  Synthetic construct
gggttcaagatacctagagac

SEQ ID NO: 6476 - DNA, 21 bp, Artificial Sequence
  Synthetic construct
ggttcaagatacctagagacg

SEQ ID NO: 6477 - DNA, 21 bp, Artificial Sequence
  Synthetic construct
gttcaagatacctagagacga

SEQ ID NO: 6478 - DNA, 21 bp, Artificial Sequence
  Synthetic construct
ttcaagatacctagagacgac

SEQ ID NO: 6479 - DNA, 21 bp, Artificial Sequence
  Synthetic construct
tcaagatacctagagacgaca

SEQ ID NO: 6480 - DNA, 21 bp, Artificial Sequence
  Synthetic construct
caagatacctagagacgacaa

SEQ ID NO: 6481 - DNA, 21 bp, Artificial Sequence
  Synthetic construct
aagatacctagagacgacaac

SEQ ID NO: 6482 - DNA, 21 bp, Artificial Sequence
  Synthetic construct
agatacctagagacgacaacc

SEQ ID NO: 6483 - DNA, 21 bp, Artificial Sequence
  Synthetic construct
gatacctagagacgacaacca

SEQ ID NO: 6484 - DNA, 21 bp, Artificial Sequence
  Synthetic construct
atacctagagacgacaaccat

SEQ ID NO: 6485 - DNA, 21 bp, Artificial Sequence
  Synthetic construct
tacctagagacgacaaccatg

SEQ ID NO: 6486 - DNA, 21 bp, Artificial Sequence
  Synthetic construct
acctagagacgacaaccatgc

SEQ ID NO: 6487 - DNA, 21 bp, Artificial Sequence
  Synthetic construct
cctagagacgacaaccatgcc

SEQ ID NO: 6488 - DNA, 21 bp, Artificial Sequence
  Synthetic construct
ctagagacgacaaccatgcca

SEQ ID NO: 6489 - DNA, 21 bp, Artificial Sequence
  Synthetic construct
tagagacgacaaccatgccaa

SEQ ID NO: 6490 - DNA, 21 bp, Artificial Sequence
  Synthetic construct
agagacgacaaccatgccaaa

SEQ ID NO: 6491 - DNA, 21 bp, Artificial Sequence
  Synthetic construct
gagacgacaaccatgccaaac

SEQ ID NO: 6492 - DNA, 21 bp, Artificial Sequence
  Synthetic construct
agacgacaaccatgccaaacg

SEQ ID NO: 6493 - DNA, 21 bp, Artificial Sequence
  Synthetic construct
gacgacaaccatgccaaacgt

SEQ ID NO: 6494 - DNA, 21 bp, Artificial Sequence
  Synthetic construct
acgacaaccatgccaaacgtg

SEQ ID NO: 6495 - DNA, 21 bp, Artificial Sequence
  Synthetic construct
cgacaaccatgccaaacgtgc

SEQ ID NO: 6496 - DNA, 21 bp, Artificial Sequence
  Synthetic construct
gacaaccatgccaaacgtgca

SEQ ID NO: 6497 - DNA, 21 bp, Artificial Sequence
  Synthetic construct
acaaccatgccaaacgtgcat

SEQ ID NO: 6498 - DNA, 21 bp, Artificial Sequence
  Synthetic construct
caaccatgccaaacgtgcatc

SEQ ID NO: 6499 - DNA, 21 bp, Artificial Sequence
  Synthetic construct
aaccatgccaaacgtgcatcg

SEQ ID NO: 6500 - DNA, 21 bp, Artificial Sequence
  Synthetic construct
accatgccaaacgtgcatcgt

SEQ ID NO: 6501 - DNA, 21 bp, Artificial Sequence
  Synthetic construct
ccatgccaaacgtgcatcgtt

SEQ ID NO: 6502 - DNA, 21 bp, Artificial Sequence
  Synthetic construct
catgccaaacgtgcatcgttt

SEQ ID NO: 6503 - DNA, 21 bp, Artificial Sequence
  Synthetic construct
atgccaaacgtgcatcgttta

SEQ ID NO: 6504 - DNA, 21 bp, Artificial Sequence
  Synthetic construct
tgccaaacgtgcatcgtttat

SEQ ID NO: 6505 - DNA, 21 bp, Artificial Sequence
  Synthetic construct
gccaaacgtgcatcgtttatg

SEQ ID NO: 6506 - DNA, 21 bp, Artificial Sequence
  Synthetic construct
ccaaacgtgcatcgtttatgt

SEQ ID NO: 6507 - DNA, 21 bp, Artificial Sequence
  Synthetic construct
caaacgtgcatcgtttatgta

SEQ ID NO: 6508 - DNA, 21 bp, Artificial Sequence
  Synthetic construct
aaacgtgcatcgtttatgtaa

SEQ ID NO: 6509 - DNA, 21 bp, Artificial Sequence
  Synthetic construct
aacgtgcatcgtttatgtaaa

SEQ ID NO: 6510 - DNA, 21 bp, Artificial Sequence
  Synthetic construct
acgtgcatcgtttatgtaaaa

SEQ ID NO: 6511 - DNA, 21 bp, Artificial Sequence
  Synthetic construct
cgtgcatcgtttatgtaaaac

SEQ ID NO: 6512 - DNA, 21 bp, Artificial Sequence
  Synthetic construct
gtgcatcgtttatgtaaaacc

SEQ ID NO: 6513 - DNA, 21 bp, Artificial Sequence
  Synthetic construct
tgcatcgtttatgtaaaacca

SEQ ID NO: 6514 - DNA, 21 bp, Artificial Sequence
  Synthetic construct
gcatcgtttatgtaaaaccat

SEQ ID NO: 6515 - DNA, 21 bp, Artificial Sequence
  Synthetic construct
catcgtttatgtaaaaccata

SEQ ID NO: 6516 - DNA, 21 bp, Artificial Sequence
  Synthetic construct
atcgtttatgtaaaaccatat

SEQ ID NO: 6517 - DNA, 21 bp, Artificial Sequence
  Synthetic construct
tcgtttatgtaaaaccatatc

SEQ ID NO: 6518 - DNA, 21 bp, Artificial Sequence
  Synthetic construct
cgtttatgtaaaaccatatca

SEQ ID NO: 6519 - DNA, 21 bp, Artificial Sequence
  Synthetic construct
gtttatgtaaaaccatatcac

SEQ ID NO: 6520 - DNA, 21 bp, Artificial Sequence
  Synthetic construct
tttatgtaaaaccatatcacg

SEQ ID NO: 6521 - DNA, 21 bp, Artificial Sequence
  Synthetic construct
ttatgtaaaaccatatcacga

SEQ ID NO: 6522 - DNA, 21 bp, Artificial Sequence
  Synthetic construct
tatgtaaaaccatatcacgat

SEQ ID NO: 6523 - DNA, 21 bp, Artificial Sequence
  Synthetic construct
atgtaaaaccatatcacgata

SEQ ID NO: 6524 - DNA, 21 bp, Artificial Sequence
  Synthetic construct
tgtaaaaccatatcacgatac

SEQ ID NO: 6525 - DNA, 21 bp, Artificial Sequence
  Synthetic construct
gtaaaaccatatcacgatacg

SEQ ID NO: 6526 - DNA, 21 bp, Artificial Sequence
  Synthetic construct
taaaaccatatcacgatacgt

SEQ ID NO: 6527 - DNA, 21 bp, Artificial Sequence
  Synthetic construct
aaaaccatatcacgatacgtc

SEQ ID NO: 6528 - DNA, 21 bp, Artificial Sequence
  Synthetic construct
aaaccatatcacgatacgtcg

SEQ ID NO: 6529 - DNA, 21 bp, Artificial Sequence
  Synthetic construct
aaccatatcacgatacgtcgc

SEQ ID NO: 6530 - DNA, 21 bp, Artificial Sequence
  Synthetic construct
accatatcacgatacgtcgcg

SEQ ID NO: 6531 - DNA, 21 bp, Artificial Sequence
  Synthetic construct
ccatatcacgatacgtcgcga

SEQ ID NO: 6532 - DNA, 21 bp, Artificial Sequence
  Synthetic construct
catatcacgatacgtcgcgat

SEQ ID NO: 6533 - DNA, 21 bp, Artificial Sequence
  Synthetic construct
atatcacgatacgtcgcgata

SEQ ID NO: 6534 - DNA, 21 bp, Artificial Sequence
  Synthetic construct
tatcacgatacgtcgcgatat

SEQ ID NO: 6535 - DNA, 21 bp, Artificial Sequence
  Synthetic construct
atcacgatacgtcgcgatatg

SEQ ID NO: 6536 - DNA, 21 bp, Artificial Sequence
  Synthetic construct
tcacgatacgtcgcgatatgt

SEQ ID NO: 6537 - DNA, 21 bp, Artificial Sequence
  Synthetic construct
cacgatacgtcgcgatatgtt

SEQ ID NO: 6538 - DNA, 21 bp, Artificial Sequence
  Synthetic construct
acgatacgtcgcgatatgttg

SEQ ID NO: 6539 - DNA, 21 bp, Artificial Sequence
  Synthetic construct
cgatacgtcgcgatatgttgc

SEQ ID NO: 6540 - DNA, 21 bp, Artificial Sequence
  Synthetic construct
gatacgtcgcgatatgttgca

SEQ ID NO: 6541 - DNA, 21 bp, Artificial Sequence
  Synthetic construct
atacgtcgcgatatgttgcac

SEQ ID NO: 6542 - DNA, 21 bp, Artificial Sequence
  Synthetic construct
tacgtcgcgatatgttgcacg

SEQ ID NO: 6543 - DNA, 21 bp, Artificial Sequence
  Synthetic construct
acgtcgcgatatgttgcacgt

SEQ ID NO: 6544 - DNA, 21 bp, Artificial Sequence
  Synthetic construct
cgtcgcgatatgttgcacgtt

SEQ ID NO: 6545 - DNA, 21 bp, Artificial Sequence
  Synthetic construct
gtcgcgatatgttgcacgttg

SEQ ID NO: 6546 - DNA, 21 bp, Artificial Sequence
  Synthetic construct
tcgcgatatgttgcacgttgt

SEQ ID NO: 6547 - DNA, 21 bp, Artificial Sequence
  Synthetic construct
cgcgatatgttgcacgttgtc

SEQ ID NO: 6548 - DNA, 21 bp, Artificial Sequence
  Synthetic construct
gcgatatgttgcacgttgtct

SEQ ID NO: 6549 - DNA, 21 bp, Artificial Sequence
  Synthetic construct
cgatatgttgcacgttgtctg

SEQ ID NO: 6550 - DNA, 21 bp, Artificial Sequence
  Synthetic construct
gatatgttgcacgttgtctgg

SEQ ID NO: 6551 - DNA, 21 bp, Artificial Sequence
  Synthetic construct
atatgttgcacgttgtctgga

SEQ ID NO: 6552 - DNA, 21 bp, Artificial Sequence
  Synthetic construct
tatgttgcacgttgtctggaa

SEQ ID NO: 6553 - DNA, 21 bp, Artificial Sequence
  Synthetic construct
atgttgcacgttgtctggaag

SEQ ID NO: 6554 - DNA, 21 bp, Artificial Sequence
  Synthetic construct
tgttgcacgttgtctggaagt

SEQ ID NO: 6555 - DNA, 21 bp, Artificial Sequence
  Synthetic construct
gttgcacgttgtctggaagtt

SEQ ID NO: 6556 - DNA, 21 bp, Artificial Sequence
  Synthetic construct
ttgcacgttgtctggaagttt

SEQ ID NO: 6557 - DNA, 21 bp, Artificial Sequence
  Synthetic construct
tgcacgttgtctggaagtttg

SEQ ID NO: 6558 - DNA, 21 bp, Artificial Sequence
  Synthetic construct
gcacgttgtctggaagtttgc

SEQ ID NO: 6559 - DNA, 21 bp, Artificial Sequence
  Synthetic construct
cacgttgtctggaagtttgca

SEQ ID NO: 6560 - DNA, 21 bp, Artificial Sequence
  Synthetic construct
acgttgtctggaagtttgcag

SEQ ID NO: 6561 - DNA, 21 bp, Artificial Sequence
  Synthetic construct
cgttgtctggaagtttgcagc

SEQ ID NO: 6562 - DNA, 21 bp, Artificial Sequence
  Synthetic construct
gttgtctggaagtttgcagct

SEQ ID NO: 6563 - DNA, 21 bp, Artificial Sequence
  Synthetic construct
ttgtctggaagtttgcagctg

SEQ ID NO: 6564 - DNA, 21 bp, Artificial Sequence
  Synthetic construct
tgtctggaagtttgcagctgg

SEQ ID NO: 6565 - DNA, 21 bp, Artificial Sequence
  Synthetic construct
gtctggaagtttgcagctgga

SEQ ID NO: 6566 - DNA, 21 bp, Artificial Sequence
  Synthetic construct
tctggaagtttgcagctggat

SEQ ID NO: 6567 - DNA, 21 bp, Artificial Sequence
  Synthetic construct
ctggaagtttgcagctggata

SEQ ID NO: 6568 - DNA, 21 bp, Artificial Sequence
  Synthetic construct
tggaagtttgcagctggatac

SEQ ID NO: 6569 - DNA, 21 bp, Artificial Sequence
  Synthetic construct
ggaagtttgcagctggatacg

SEQ ID NO: 6570 - DNA, 21 bp, Artificial Sequence
  Synthetic construct
gaagtttgcagctggatacga

SEQ ID NO: 6571 - DNA, 21 bp, Artificial Sequence
  Synthetic construct
aagtttgcagctggatacgac

SEQ ID NO: 6572 - DNA, 21 bp, Artificial Sequence
  Synthetic construct
agtttgcagctggatacgaca

SEQ ID NO: 6573 - DNA, 21 bp, Artificial Sequence
  Synthetic construct
gtttgcagctggatacgacag

SEQ ID NO: 6574 - DNA, 21 bp, Artificial Sequence
  Synthetic construct
tttgcagctggatacgacaga

SEQ ID NO: 6575 - DNA, 21 bp, Artificial Sequence
  Synthetic construct
ttgcagctggatacgacagac

SEQ ID NO: 6576 - DNA, 21 bp, Artificial Sequence
  Synthetic construct
tgcagctggatacgacagacg

SEQ ID NO: 6577 - DNA, 21 bp, Artificial Sequence
  Synthetic construct
gcagctggatacgacagacgg

SEQ ID NO: 6578 - DNA, 21 bp, Artificial Sequence
  Synthetic construct
cagctggatacgacagacggc

SEQ ID NO: 6579 - DNA, 21 bp, Artificial Sequence
  Synthetic construct
agctggatacgacagacggcc

SEQ ID NO: 6580 - DNA, 21 bp, Artificial Sequence
  Synthetic construct
gctggatacgacagacggcca

SEQ ID NO: 6581 - DNA, 21 bp, Artificial Sequence
  Synthetic construct
ctggatacgacagacggccat

SEQ ID NO: 6582 - DNA, 21 bp, Artificial Sequence
  Synthetic construct
tggatacgacagacggccatc

SEQ ID NO: 6583 - DNA, 21 bp, Artificial Sequence
  Synthetic construct
ggatacgacagacggccatct

SEQ ID NO: 6584 - DNA, 21 bp, Artificial Sequence
  Synthetic construct
gatacgacagacggccatcta

SEQ ID NO: 6585 - DNA, 21 bp, Artificial Sequence
  Synthetic construct
atacgacagacggccatctaa

SEQ ID NO: 6586 - DNA, 21 bp, Artificial Sequence
  Synthetic construct
tacgacagacggccatctaac

SEQ ID NO: 6587 - DNA, 21 bp, Artificial Sequence
  Synthetic construct
acgacagacggccatctaact

SEQ ID NO: 6588 - DNA, 21 bp, Artificial Sequence
  Synthetic construct
cgacagacggccatctaactt

SEQ ID NO: 6589 - DNA, 21 bp, Artificial Sequence
  Synthetic construct
gacagacggccatctaacttg

SEQ ID NO: 6590 - DNA, 21 bp, Artificial Sequence
  Synthetic construct
acagacggccatctaacttga

SEQ ID NO: 6591 - DNA, 21 bp, Artificial Sequence
  Synthetic construct
cagacggccatctaacttgat

SEQ ID NO: 6592 - DNA, 21 bp, Artificial Sequence
  Synthetic construct
agacggccatctaacttgatg

SEQ ID NO: 6593 - DNA, 21 bp, Artificial Sequence
  Synthetic construct
gacggccatctaacttgatgt

SEQ ID NO: 6594 - DNA, 21 bp, Artificial Sequence
  Synthetic construct
acggccatctaacttgatgtt

SEQ ID NO: 6595 - DNA, 21 bp, Artificial Sequence
  Synthetic construct
cggccatctaacttgatgtta

SEQ ID NO: 6596 - DNA, 21 bp, Artificial Sequence
  Synthetic construct
ggccatctaacttgatgttag

SEQ ID NO: 6597 - DNA, 21 bp, Artificial Sequence
  Synthetic construct
gccatctaacttgatgttagt

SEQ ID NO: 6598 - DNA, 21 bp, Artificial Sequence
  Synthetic construct
ccatctaacttgatgttagta

SEQ ID NO: 6599 - DNA, 21 bp, Artificial Sequence
  Synthetic construct
catctaacttgatgttagtac

SEQ ID NO: 6600 - DNA, 21 bp, Artificial Sequence
  Synthetic construct
atctaacttgatgttagtacc

SEQ ID NO: 6601 - DNA, 21 bp, Artificial Sequence
  Synthetic construct
tctaacttgatgttagtaccg

SEQ ID NO: 6602 - DNA, 21 bp, Artificial Sequence
  Synthetic construct
ctaacttgatgttagtaccga

SEQ ID NO: 6603 - DNA, 21 bp, Artificial Sequence
  Synthetic construct
taacttgatgttagtaccgac

SEQ ID NO: 6604 - DNA, 21 bp, Artificial Sequence
  Synthetic construct
aacttgatgttagtaccgacc

SEQ ID NO: 6605 - DNA, 21 bp, Artificial Sequence
  Synthetic construct
acttgatgttagtaccgacct

SEQ ID NO: 6606 - DNA, 21 bp, Artificial Sequence
  Synthetic construct
cttgatgttagtaccgacctg

SEQ ID NO: 6607 - DNA, 21 bp, Artificial Sequence
  Synthetic construct
ttgatgttagtaccgacctga

SEQ ID NO: 6608 - DNA, 21 bp, Artificial Sequence
  Synthetic construct
tgatgttagtaccgacctgac

SEQ ID NO: 6609 - DNA, 21 bp, Artificial Sequence
  Synthetic construct
gatgttagtaccgacctgacg

SEQ ID NO: 6610 - DNA, 21 bp, Artificial Sequence
  Synthetic construct
atgttagtaccgacctgacgt

SEQ ID NO: 6611 - DNA, 21 bp, Artificial Sequence
  Synthetic construct
tgttagtaccgacctgacgta

SEQ ID NO: 6612 - DNA, 21 bp, Artificial Sequence
  Synthetic construct
gttagtaccgacctgacgtac

SEQ ID NO: 6613 - DNA, 21 bp, Artificial Sequence
  Synthetic construct
ttagtaccgacctgacgtacg

SEQ ID NO: 6614 - DNA, 21 bp, Artificial Sequence
  Synthetic construct
tagtaccgacctgacgtacgg

SEQ ID NO: 6615 - DNA, 21 bp, Artificial Sequence
  Synthetic construct
agtaccgacctgacgtacggc

SEQ ID NO: 6616 - DNA, 21 bp, Artificial Sequence
  Synthetic construct
gtaccgacctgacgtacggct

SEQ ID NO: 6617 - DNA, 21 bp, Artificial Sequence
  Synthetic construct
taccgacctgacgtacggctc

SEQ ID NO: 6618 - DNA, 21 bp, Artificial Sequence
  Synthetic construct
accgacctgacgtacggctct

SEQ ID NO: 6619 - DNA, 21 bp, Artificial Sequence
  Synthetic construct
ccgacctgacgtacggctctc

SEQ ID NO: 6620 - DNA, 21 bp, Artificial Sequence
  Synthetic construct
cgacctgacgtacggctctca

SEQ ID NO: 6621 - DNA, 21 bp, Artificial Sequence
  Synthetic construct
gacctgacgtacggctctcat

SEQ ID NO: 6622 - DNA, 21 bp, Artificial Sequence
  Synthetic construct
acctgacgtacggctctcata

SEQ ID NO: 6623 - DNA, 21 bp, Artificial Sequence
  Synthetic construct
cctgacgtacggctctcatag

SEQ ID NO: 6624 - DNA, 21 bp, Artificial Sequence
  Synthetic construct
ctgacgtacggctctcatagg

SEQ ID NO: 6625 - DNA, 21 bp, Artificial Sequence
  Synthetic construct
tgacgtacggctctcatagga

SEQ ID NO: 6626 - DNA, 21 bp, Artificial Sequence
  Synthetic construct
gacgtacggctctcataggaa

SEQ ID NO: 6627 - DNA, 21 bp, Artificial Sequence
  Synthetic construct
acgtacggctctcataggaag

SEQ ID NO: 6628 - DNA, 21 bp, Artificial Sequence
  Synthetic construct
cgtacggctctcataggaaga

SEQ ID NO: 6629 - DNA, 21 bp, Artificial Sequence
  Synthetic construct
gtacggctctcataggaagaa

SEQ ID NO: 6630 - DNA, 21 bp, Artificial Sequence
  Synthetic construct
tacggctctcataggaagaaa

SEQ ID NO: 6631 - DNA, 21 bp, Artificial Sequence
  Synthetic construct
acggctctcataggaagaaac

SEQ ID NO: 6632 - DNA, 21 bp, Artificial Sequence
  Synthetic construct
cggctctcataggaagaaact

SEQ ID NO: 6633 - DNA, 21 bp, Artificial Sequence
  Synthetic construct
ggctctcataggaagaaactc

SEQ ID NO: 6634 - DNA, 21 bp, Artificial Sequence
  Synthetic construct
gctctcataggaagaaactct

SEQ ID NO: 6635 - DNA, 21 bp, Artificial Sequence
  Synthetic construct
ctctcataggaagaaactctt

SEQ ID NO: 6636 - DNA, 21 bp, Artificial Sequence
  Synthetic construct
tctcataggaagaaactcttg

SEQ ID NO: 6637 - DNA, 21 bp, Artificial Sequence
  Synthetic construct
ctcataggaagaaactcttga

SEQ ID NO: 6638 - DNA, 21 bp, Artificial Sequence
  Synthetic construct
tcataggaagaaactcttgaa

SEQ ID NO: 6639 - DNA, 21 bp, Artificial Sequence
  Synthetic construct
cataggaagaaactcttgaag

SEQ ID NO: 6640 - DNA, 21 bp, Artificial Sequence
  Synthetic construct
ataggaagaaactcttgaagg

SEQ ID NO: 6641 - DNA, 21 bp, Artificial Sequence
  Synthetic construct
taggaagaaactcttgaaggt

SEQ ID NO: 6642 - DNA, 21 bp, Artificial Sequence
  Synthetic construct
aggaagaaactcttgaaggtg

SEQ ID NO: 6643 - DNA, 21 bp, Artificial Sequence
  Synthetic construct
ggaagaaactcttgaaggtga

SEQ ID NO: 6644 - DNA, 21 bp, Artificial Sequence
  Synthetic construct
gaagaaactcttgaaggtgaa

SEQ ID NO: 6645 - DNA, 21 bp, Artificial Sequence
  Synthetic construct
aagaaactcttgaaggtgaac

SEQ ID NO: 6646 - DNA, 21 bp, Artificial Sequence
  Synthetic construct
agaaactcttgaaggtgaacc

SEQ ID NO: 6647 - DNA, 21 bp, Artificial Sequence
  Synthetic construct
gaaactcttgaaggtgaacct

SEQ ID NO: 6648 - DNA, 21 bp, Artificial Sequence
  Synthetic construct
aaactcttgaaggtgaacctt

SEQ ID NO: 6649 - DNA, 21 bp, Artificial Sequence
  Synthetic construct
aactcttgaaggtgaaccttc

SEQ ID NO: 6650 - DNA, 21 bp, Artificial Sequence
  Synthetic construct
actcttgaaggtgaaccttcg

SEQ ID NO: 6651 - DNA, 21 bp, Artificial Sequence
  Synthetic construct
ctcttgaaggtgaaccttcgt

SEQ ID NO: 6652 - DNA, 21 bp, Artificial Sequence
  Synthetic construct
tcttgaaggtgaaccttcgta

SEQ ID NO: 6653 - DNA, 21 bp, Artificial Sequence
  Synthetic construct
cttgaaggtgaaccttcgtaa

SEQ ID NO: 6654 - DNA, 21 bp, Artificial Sequence
  Synthetic construct
ttgaaggtgaaccttcgtaag

SEQ ID NO: 6655 - DNA, 21 bp, Artificial Sequence
  Synthetic construct
tgaaggtgaaccttcgtaagc

SEQ ID NO: 6656 - DNA, 21 bp, Artificial Sequence
  Synthetic construct
gaaggtgaaccttcgtaagca

SEQ ID NO: 6657 - DNA, 21 bp, Artificial Sequence
  Synthetic construct
aaggtgaaccttcgtaagcat

SEQ ID NO: 6658 - DNA, 21 bp, Artificial Sequence
  Synthetic construct
aggtgaaccttcgtaagcatc

SEQ ID NO: 6659 - DNA, 21 bp, Artificial Sequence
  Synthetic construct
ggtgaaccttcgtaagcatct

SEQ ID NO: 6660 - DNA, 21 bp, Artificial Sequence
  Synthetic construct
gtgaaccttcgtaagcatctc

SEQ ID NO: 6661 - DNA, 21 bp, Artificial Sequence
  Synthetic construct
tgaaccttcgtaagcatctca

SEQ ID NO: 6662 - DNA, 21 bp, Artificial Sequence
  Synthetic construct
gaaccttcgtaagcatctcat

SEQ ID NO: 6663 - DNA, 21 bp, Artificial Sequence
  Synthetic construct
aaccttcgtaagcatctcata

SEQ ID NO: 6664 - DNA, 21 bp, Artificial Sequence
  Synthetic construct
accttcgtaagcatctcatat

SEQ ID NO: 6665 - DNA, 21 bp, Artificial Sequence
  Synthetic construct
ccttcgtaagcatctcatatg

SEQ ID NO: 6666 - DNA, 21 bp, Artificial Sequence
  Synthetic construct
cttcgtaagcatctcatatgc

SEQ ID NO: 6667 - DNA, 21 bp, Artificial Sequence
  Synthetic construct
ttcgtaagcatctcatatgca

SEQ ID NO: 6668 - DNA, 21 bp, Artificial Sequence
  Synthetic construct
tcgtaagcatctcatatgcac

SEQ ID NO: 6669 - DNA, 21 bp, Artificial Sequence
  Synthetic construct
cgtaagcatctcatatgcacc

SEQ ID NO: 6670 - DNA, 21 bp, Artificial Sequence
  Synthetic construct
gtaagcatctcatatgcaccc

SEQ ID NO: 6671 - DNA, 21 bp, Artificial Sequence
  Synthetic construct
taagcatctcatatgcaccct

SEQ ID NO: 6672 - DNA, 21 bp, Artificial Sequence
  Synthetic construct
aagcatctcatatgcaccctg

SEQ ID NO: 6673 - DNA, 21 bp, Artificial Sequence
  Synthetic construct
agcatctcatatgcaccctgg

SEQ ID NO: 6674 - DNA, 21 bp, Artificial Sequence
  Synthetic construct
gcatctcatatgcaccctgga

SEQ ID NO: 6675 - DNA, 21 bp, Artificial Sequence
  Synthetic construct
catctcatatgcaccctggat

SEQ ID NO: 6676 - DNA, 21 bp, Artificial Sequence
  Synthetic construct
atctcatatgcaccctggata

SEQ ID NO: 6677 - DNA, 21 bp, Artificial Sequence
  Synthetic construct
tctcatatgcaccctggatat

SEQ ID NO: 6678 - DNA, 21 bp, Artificial Sequence
  Synthetic construct
ctcatatgcaccctggatatc

SEQ ID NO: 6679 - DNA, 21 bp, Artificial Sequence
  Synthetic construct
tcatatgcaccctggatatca

SEQ ID NO: 6680 - DNA, 21 bp, Artificial Sequence
  Synthetic construct
catatgcaccctggatatcac

SEQ ID NO: 6681 - DNA, 21 bp, Artificial Sequence
  Synthetic construct
atatgcaccctggatatcact

SEQ ID NO: 6682 - DNA, 21 bp, Artificial Sequence
  Synthetic construct
tatgcaccctggatatcactc

SEQ ID NO: 6683 - DNA, 21 bp, Artificial Sequence
  Synthetic construct
atgcaccctggatatcactca

SEQ ID NO: 6684 - DNA, 21 bp, Artificial Sequence
  Synthetic construct
tgcaccctggatatcactcat

SEQ ID NO: 6685 - DNA, 21 bp, Artificial Sequence
  Synthetic construct
gcaccctggatatcactcatt

SEQ ID NO: 6686 - DNA, 21 bp, Artificial Sequence
  Synthetic construct
caccctggatatcactcatta

SEQ ID NO: 6687 - DNA, 21 bp, Artificial Sequence
  Synthetic construct
accctggatatcactcattag

SEQ ID NO: 6688 - DNA, 21 bp, Artificial Sequence
  Synthetic construct
ccctggatatcactcattagt

SEQ ID NO: 6689 - DNA, 21 bp, Artificial Sequence
  Synthetic construct
cctggatatcactcattagtg

SEQ ID NO: 6690 - DNA, 21 bp, Artificial Sequence
  Synthetic construct
ctggatatcactcattagtgg

SEQ ID NO: 6691 - DNA, 21 bp, Artificial Sequence
  Synthetic construct
tggatatcactcattagtggt

SEQ ID NO: 6692 - DNA, 21 bp, Artificial Sequence
  Synthetic construct
ggatatcactcattagtggta

SEQ ID NO: 6693 - DNA, 21 bp, Artificial Sequence
  Synthetic construct
gatatcactcattagtggtaa

SEQ ID NO: 6694 - DNA, 21 bp, Artificial Sequence
  Synthetic construct
atatcactcattagtggtaac

SEQ ID NO: 6695 - DNA, 21 bp, Artificial Sequence
  Synthetic construct
tatcactcattagtggtaacc

SEQ ID NO: 6696 - DNA, 21 bp, Artificial Sequence
  Synthetic construct
atcactcattagtggtaacca

SEQ ID NO: 6697 - DNA, 21 bp, Artificial Sequence
  Synthetic construct
tcactcattagtggtaaccaa

SEQ ID NO: 6698 - DNA, 21 bp, Artificial Sequence
  Synthetic construct
cactcattagtggtaaccaac

SEQ ID NO: 6699 - DNA, 21 bp, Artificial Sequence
  Synthetic construct
actcattagtggtaaccaacc

SEQ ID NO: 6700 - DNA, 21 bp, Artificial Sequence
  Synthetic construct
ctcattagtggtaaccaaccg

SEQ ID NO: 6701 - DNA, 21 bp, Artificial Sequence
  Synthetic construct
tcattagtggtaaccaaccga

SEQ ID NO: 6702 - DNA, 21 bp, Artificial Sequence
  Synthetic construct
cattagtggtaaccaaccgaa

SEQ ID NO: 6703 - DNA, 21 bp, Artificial Sequence
  Synthetic construct
attagtggtaaccaaccgaac

SEQ ID NO: 6704 - DNA, 21 bp, Artificial Sequence
  Synthetic construct
ttagtggtaaccaaccgaact

SEQ ID NO: 6705 - DNA, 21 bp, Artificial Sequence
  Synthetic construct
tagtggtaaccaaccgaactg

SEQ ID NO: 6706 - DNA, 21 bp, Artificial Sequence
  Synthetic construct
agtggtaaccaaccgaactgc

SEQ ID NO: 6707 - DNA, 21 bp, Artificial Sequence
  Synthetic construct
gtggtaaccaaccgaactgca

SEQ ID NO: 6708 - DNA, 21 bp, Artificial Sequence
  Synthetic construct
tggtaaccaaccgaactgcaa

SEQ ID NO: 6709 - DNA, 21 bp, Artificial Sequence
  Synthetic construct
ggtaaccaaccgaactgcaac

SEQ ID NO: 6710 - DNA, 21 bp, Artificial Sequence
  Synthetic construct
gtaaccaaccgaactgcaact

SEQ ID NO: 6711 - DNA, 21 bp, Artificial Sequence
  Synthetic construct
taaccaaccgaactgcaactc

SEQ ID NO: 6712 - DNA, 21 bp, Artificial Sequence
  Synthetic construct
aaccaaccgaactgcaactcc

SEQ ID NO: 6713 - DNA, 21 bp, Artificial Sequence
  Synthetic construct
accaaccgaactgcaactcca

SEQ ID NO: 6714 - DNA, 21 bp, Artificial Sequence
  Synthetic construct
ccaaccgaactgcaactccaa

SEQ ID NO: 6715 - DNA, 21 bp, Artificial Sequence
  Synthetic construct
caaccgaactgcaactccaac

SEQ ID NO: 6716 - DNA, 21 bp, Artificial Sequence
  Synthetic construct
aaccgaactgcaactccaacc

SEQ ID NO: 6717 - DNA, 21 bp, Artificial Sequence
  Synthetic construct
accgaactgcaactccaacca

SEQ ID NO: 6718 - DNA, 21 bp, Artificial Sequence
  Synthetic construct
ccgaactgcaactccaaccac

SEQ ID NO: 6719 - DNA, 21 bp, Artificial Sequence
  Synthetic construct
cgaactgcaactccaaccacc

SEQ ID NO: 6720 - DNA, 21 bp, Artificial Sequence
  Synthetic construct
gaactgcaactccaaccacct

SEQ ID NO: 6721 - DNA, 21 bp, Artificial Sequence
  Synthetic construct
aactgcaactccaaccacctg

SEQ ID NO: 6722 - DNA, 21 bp, Artificial Sequence
  Synthetic construct
actgcaactccaaccacctgc

SEQ ID NO: 6723 - DNA, 21 bp, Artificial Sequence
  Synthetic construct
ctgcaactccaaccacctgcc

SEQ ID NO: 6724 - DNA, 21 bp, Artificial Sequence
  Synthetic construct
tgcaactccaaccacctgccg

SEQ ID NO: 6725 - DNA, 21 bp, Artificial Sequence
  Synthetic construct
gcaactccaaccacctgccgg

SEQ ID NO: 6726 - DNA, 21 bp, Artificial Sequence
  Synthetic construct
caactccaaccacctgccggc

SEQ ID NO: 6727 - DNA, 21 bp, Artificial Sequence
  Synthetic construct
aactccaaccacctgccggcc

SEQ ID NO: 6728 - DNA, 21 bp, Artificial Sequence
  Synthetic construct
actccaaccacctgccggcca

SEQ ID NO: 6729 - DNA, 21 bp, Artificial Sequence
  Synthetic construct
ctccaaccacctgccggccac

SEQ ID NO: 6730 - DNA, 21 bp, Artificial Sequence
  Synthetic construct
tccaaccacctgccggccacg

SEQ ID NO: 6731 - DNA, 21 bp, Artificial Sequence
  Synthetic construct
ccaaccacctgccggccacgt

SEQ ID NO: 6732 - DNA, 21 bp, Artificial Sequence
  Synthetic construct
caaccacctgccggccacgtg

SEQ ID NO: 6733 - DNA, 21 bp, Artificial Sequence
  Synthetic construct
aaccacctgccggccacgtgt

SEQ ID NO: 6734 - DNA, 21 bp, Artificial Sequence
  Synthetic construct
accacctgccggccacgtgtt

SEQ ID NO: 6735 - DNA, 21 bp, Artificial Sequence
  Synthetic construct
ccacctgccggccacgtgttt

SEQ ID NO: 6736 - DNA, 21 bp, Artificial Sequence
  Synthetic construct
cacctgccggccacgtgtttt

SEQ ID NO: 6737 - DNA, 21 bp, Artificial Sequence
  Synthetic construct
acctgccggccacgtgttttg

SEQ ID NO: 6738 - DNA, 21 bp, Artificial Sequence
  Synthetic construct
cctgccggccacgtgttttga

SEQ ID NO: 6739 - DNA, 21 bp, Artificial Sequence
  Synthetic construct
ctgccggccacgtgttttgat

SEQ ID NO: 6740 - DNA, 21 bp, Artificial Sequence
  Synthetic construct
tgccggccacgtgttttgatc

SEQ ID NO: 6741 - DNA, 21 bp, Artificial Sequence
  Synthetic construct
gccggccacgtgttttgatcg

SEQ ID NO: 6742 - DNA, 21 bp, Artificial Sequence
  Synthetic construct
ccggccacgtgttttgatcga

SEQ ID NO: 6743 - DNA, 21 bp, Artificial Sequence
  Synthetic construct
cggccacgtgttttgatcgaa

SEQ ID NO: 6744 - DNA, 21 bp, Artificial Sequence
  Synthetic construct
ggccacgtgttttgatcgaaa

SEQ ID NO: 6745 - DNA, 21 bp, Artificial Sequence
  Synthetic construct
gccacgtgttttgatcgaaac

SEQ ID NO: 6746 - DNA, 21 bp, Artificial Sequence
  Synthetic construct
ccacgtgttttgatcgaaact

SEQ ID NO: 6747 - DNA, 21 bp, Artificial Sequence
  Synthetic construct
cacgtgttttgatcgaaactt

SEQ ID NO: 6748 - DNA, 21 bp, Artificial Sequence
  Synthetic construct
acgtgttttgatcgaaacttt

SEQ ID NO: 6749 - DNA, 21 bp, Artificial Sequence
  Synthetic construct
cgtgttttgatcgaaactttc

SEQ ID NO: 6750 - DNA, 21 bp, Artificial Sequence
  Synthetic construct
gtgttttgatcgaaactttcg

SEQ ID NO: 6751 - DNA, 21 bp, Artificial Sequence
  Synthetic construct
tgttttgatcgaaactttcga

SEQ ID NO: 6752 - DNA, 21 bp, Artificial Sequence
  Synthetic construct
gttttgatcgaaactttcgat

SEQ ID NO: 6753 - DNA, 21 bp, Artificial Sequence
  Synthetic construct
ttttgatcgaaactttcgatc

SEQ ID NO: 6754 - DNA, 21 bp, Artificial Sequence
  Synthetic construct
tttgatcgaaactttcgatct

SEQ ID NO: 6755 - DNA, 21 bp, Artificial Sequence
  Synthetic construct
ttgatcgaaactttcgatctt

SEQ ID NO: 6756 - DNA, 21 bp, Artificial Sequence
  Synthetic construct
tgatcgaaactttcgatcttc

SEQ ID NO: 6757 - DNA, 21 bp, Artificial Sequence
  Synthetic construct
gatcgaaactttcgatcttcg

SEQ ID NO: 6758 - DNA, 21 bp, Artificial Sequence
  Synthetic construct
atcgaaactttcgatcttcgt

SEQ ID NO: 6759 - DNA, 21 bp, Artificial Sequence
  Synthetic construct
tcgaaactttcgatcttcgtt

SEQ ID NO: 6760 - DNA, 21 bp, Artificial Sequence
  Synthetic construct
cgaaactttcgatcttcgttt

SEQ ID NO: 6761 - DNA, 21 bp, Artificial Sequence
  Synthetic construct
gaaactttcgatcttcgttta

SEQ ID NO: 6762 - DNA, 21 bp, Artificial Sequence
  Synthetic construct
aaactttcgatcttcgtttag

SEQ ID NO: 6763 - DNA, 21 bp, Artificial Sequence
  Synthetic construct
aactttcgatcttcgtttagg

SEQ ID NO: 6764 - DNA, 21 bp, Artificial Sequence
  Synthetic construct
actttcgatcttcgtttaggg

SEQ ID NO: 6765 - DNA, 21 bp, Artificial Sequence
  Synthetic construct
ctttcgatcttcgtttagggc

SEQ ID NO: 6766 - DNA, 21 bp, Artificial Sequence
  Synthetic construct
tttcgatcttcgtttagggca

SEQ ID NO: 6767 - DNA, 21 bp, Artificial Sequence
  Synthetic construct
ttcgatcttcgtttagggcaa

SEQ ID NO: 6768 - DNA, 21 bp, Artificial Sequence
  Synthetic construct
tcgatcttcgtttagggcaag

SEQ ID NO: 6769 - DNA, 21 bp, Artificial Sequence
  Synthetic construct
cgatcttcgtttagggcaagg

SEQ ID NO: 6770 - DNA, 21 bp, Artificial Sequence
  Synthetic construct
gatcttcgtttagggcaaggt

SEQ ID NO: 6771 - DNA, 21 bp, Artificial Sequence
  Synthetic construct
atcttcgtttagggcaaggta

SEQ ID NO: 6772 - DNA, 21 bp, Artificial Sequence
  Synthetic construct
tcttcgtttagggcaaggtag

SEQ ID NO: 6773 - DNA, 21 bp, Artificial Sequence
  Synthetic construct
cttcgtttagggcaaggtagc

SEQ ID NO: 6774 - DNA, 21 bp, Artificial Sequence
  Synthetic construct
ttcgtttagggcaaggtagcg

SEQ ID NO: 6775 - DNA, 21 bp, Artificial Sequence
  Synthetic construct
tcgtttagggcaaggtagcgg

SEQ ID NO: 6776 - DNA, 21 bp, Artificial Sequence
  Synthetic construct
cgtttagggcaaggtagcgga

SEQ ID NO: 6777 - DNA, 21 bp, Artificial Sequence
  Synthetic construct
gtttagggcaaggtagcggag

SEQ ID NO: 6778 - DNA, 21 bp, Artificial Sequence
  Synthetic construct
tttagggcaaggtagcggagc

SEQ ID NO: 6779 - DNA, 21 bp, Artificial Sequence
  Synthetic construct
ttagggcaaggtagcggagcg

SEQ ID NO: 6780 - DNA, 21 bp, Artificial Sequence
  Synthetic construct
tagggcaaggtagcggagcgc

SEQ ID NO: 6781 - DNA, 21 bp, Artificial Sequence
  Synthetic construct
agggcaaggtagcggagcgcc

SEQ ID NO: 6782 - DNA, 21 bp, Artificial Sequence
  Synthetic construct
gggcaaggtagcggagcgcct

SEQ ID NO: 6783 - DNA, 21 bp, Artificial Sequence
  Synthetic construct
ggcaaggtagcggagcgcctg

SEQ ID NO: 6784 - DNA, 21 bp, Artificial Sequence
  Synthetic construct
gcaaggtagcggagcgcctgg

SEQ ID NO: 6785 - DNA, 21 bp, Artificial Sequence
  Synthetic construct
caaggtagcggagcgcctggc

SEQ ID NO: 6786 - DNA, 21 bp, Artificial Sequence
  Synthetic construct
aaggtagcggagcgcctggcg

SEQ ID NO: 6787 - DNA, 21 bp, Artificial Sequence
  Synthetic construct
aggtagcggagcgcctggcgc

SEQ ID NO: 6788 - DNA, 21 bp, Artificial Sequence
  Synthetic construct
ggtagcggagcgcctggcgcc

SEQ ID NO: 6789 - DNA, 21 bp, Artificial Sequence
  Synthetic construct
gtagcggagcgcctggcgcca

SEQ ID NO: 6790 - DNA, 21 bp, Artificial Sequence
  Synthetic construct
tagcggagcgcctggcgccaa

SEQ ID NO: 6791 - DNA, 21 bp, Artificial Sequence
  Synthetic construct
agcggagcgcctggcgccaat

SEQ ID NO: 6792 - DNA, 21 bp, Artificial Sequence
  Synthetic construct
gcggagcgcctggcgccaatt

SEQ ID NO: 6793 - DNA, 21 bp, Artificial Sequence
  Synthetic construct
cggagcgcctggcgccaatta

SEQ ID NO: 6794 - DNA, 21 bp, Artificial Sequence
  Synthetic construct
ggagcgcctggcgccaattac

SEQ ID NO: 6795 - DNA, 21 bp, Artificial Sequence
  Synthetic construct
gagcgcctggcgccaattacc

SEQ ID NO: 6796 - DNA, 21 bp, Artificial Sequence
  Synthetic construct
agcgcctggcgccaattaccg

SEQ ID NO: 6797 - DNA, 21 bp, Artificial Sequence
  Synthetic construct
gcgcctggcgccaattaccgc

SEQ ID NO: 6798 - DNA, 21 bp, Artificial Sequence
  Synthetic construct
cgcctggcgccaattaccgcg

SEQ ID NO: 6799 - DNA, 21 bp, Artificial Sequence
  Synthetic construct
gcctggcgccaattaccgcga

SEQ ID NO: 6800 - DNA, 21 bp, Artificial Sequence
  Synthetic construct
cctggcgccaattaccgcgac

SEQ ID NO: 6801 - DNA, 21 bp, Artificial Sequence
  Synthetic construct
ctggcgccaattaccgcgacg

SEQ ID NO: 6802 - DNA, 21 bp, Artificial Sequence
  Synthetic construct
tggcgccaattaccgcgacga

SEQ ID NO: 6803 - DNA, 21 bp, Artificial Sequence
  Synthetic construct
ggcgccaattaccgcgacgag

SEQ ID NO: 6804 - DNA, 21 bp, Artificial Sequence
  Synthetic construct
gcgccaattaccgcgacgagc

SEQ ID NO: 6805 - DNA, 21 bp, Artificial Sequence
  Synthetic construct
cgccaattaccgcgacgagcg

SEQ ID NO: 6806 - DNA, 21 bp, Artificial Sequence
  Synthetic construct
gccaattaccgcgacgagcgg

SEQ ID NO: 6807 - DNA, 21 bp, Artificial Sequence
  Synthetic construct
ccaattaccgcgacgagcggc

SEQ ID NO: 6808 - DNA, 21 bp, Artificial Sequence
  Synthetic construct
caattaccgcgacgagcggca

SEQ ID NO: 6809 - DNA, 21 bp, Artificial Sequence
  Synthetic construct
aattaccgcgacgagcggcag

SEQ ID NO: 6810 - DNA, 21 bp, Artificial Sequence
  Synthetic construct
attaccgcgacgagcggcagt

SEQ ID NO: 6811 - DNA, 21 bp, Artificial Sequence
  Synthetic construct
ttaccgcgacgagcggcagtg

SEQ ID NO: 6812 - DNA, 21 bp, Artificial Sequence
  Synthetic construct
taccgcgacgagcggcagtgt

SEQ ID NO: 6813 - DNA, 21 bp, Artificial Sequence
  Synthetic construct
accgcgacgagcggcagtgta

SEQ ID NO: 6814 - DNA, 21 bp, Artificial Sequence
  Synthetic construct
ccgcgacgagcggcagtgtac

SEQ ID NO: 6815 - DNA, 21 bp, Artificial Sequence
  Synthetic construct
cgcgacgagcggcagtgtacg

SEQ ID NO: 6816 - DNA, 21 bp, Artificial Sequence
  Synthetic construct
gcgacgagcggcagtgtacgc

SEQ ID NO: 6817 - DNA, 21 bp, Artificial Sequence
  Synthetic construct
cgacgagcggcagtgtacgcc

SEQ ID NO: 6818 - DNA, 21 bp, Artificial Sequence
  Synthetic construct
gacgagcggcagtgtacgcct

SEQ ID NO: 6819 - DNA, 21 bp, Artificial Sequence
  Synthetic construct
acgagcggcagtgtacgcctt

SEQ ID NO: 6820 - DNA, 21 bp, Artificial Sequence
  Synthetic construct
cgagcggcagtgtacgccttc

SEQ ID NO: 6821 - DNA, 21 bp, Artificial Sequence
  Synthetic construct
gagcggcagtgtacgccttca

SEQ ID NO: 6822 - DNA, 21 bp, Artificial Sequence
  Synthetic construct
agcggcagtgtacgccttcac

SEQ ID NO: 6823 - DNA, 21 bp, Artificial Sequence
  Synthetic construct
gcggcagtgtacgccttcacg

SEQ ID NO: 6824 - DNA, 21 bp, Artificial Sequence
  Synthetic construct
cggcagtgtacgccttcacga

SEQ ID NO: 6825 - DNA, 21 bp, Artificial Sequence
  Synthetic construct
ggcagtgtacgccttcacgag

SEQ ID NO: 6826 - DNA, 21 bp, Artificial Sequence
  Synthetic construct
gcagtgtacgccttcacgagc

SEQ ID NO: 6827 - DNA, 21 bp, Artificial Sequence
  Synthetic construct
cagtgtacgccttcacgagcg

SEQ ID NO: 6828 - DNA, 21 bp, Artificial Sequence
  Synthetic construct
agtgtacgccttcacgagcgc

SEQ ID NO: 6829 - DNA, 21 bp, Artificial Sequence
  Synthetic construct
gtgtacgccttcacgagcgca

SEQ ID NO: 6830 - DNA, 21 bp, Artificial Sequence
  Synthetic construct
tgtacgccttcacgagcgcaa

SEQ ID NO: 6831 - DNA, 21 bp, Artificial Sequence
  Synthetic construct
gtacgccttcacgagcgcaat

SEQ ID NO: 6832 - DNA, 21 bp, Artificial Sequence
  Synthetic construct
tacgccttcacgagcgcaatg

SEQ ID NO: 6833 - DNA, 21 bp, Artificial Sequence
  Synthetic construct
acgccttcacgagcgcaatgg

SEQ ID NO: 6834 - DNA, 21 bp, Artificial Sequence
  Synthetic construct
cgccttcacgagcgcaatggt

SEQ ID NO: 6835 - DNA, 21 bp, Artificial Sequence
  Synthetic construct
gccttcacgagcgcaatggtt

SEQ ID NO: 6836 - DNA, 21 bp, Artificial Sequence
  Synthetic construct
ccttcacgagcgcaatggttt

SEQ ID NO: 6837 - DNA, 21 bp, Artificial Sequence
  Synthetic construct
cttcacgagcgcaatggtttg

SEQ ID NO: 6838 - DNA, 21 bp, Artificial Sequence
  Synthetic construct
ttcacgagcgcaatggtttgc

SEQ ID NO: 6839 - DNA, 21 bp, Artificial Sequence
  Synthetic construct
tcacgagcgcaatggtttgcg

SEQ ID NO: 6840 - DNA, 21 bp, Artificial Sequence
  Synthetic construct
cacgagcgcaatggtttgcgt

SEQ ID NO: 6841 - DNA, 21 bp, Artificial Sequence
  Synthetic construct
acgagcgcaatggtttgcgtc

SEQ ID NO: 6842 - DNA, 21 bp, Artificial Sequence
  Synthetic construct
cgagcgcaatggtttgcgtcg

SEQ ID NO: 6843 - DNA, 21 bp, Artificial Sequence
  Synthetic construct
gagcgcaatggtttgcgtcgc

SEQ ID NO: 6844 - DNA, 21 bp, Artificial Sequence
  Synthetic construct
agcgcaatggtttgcgtcgcg

SEQ ID NO: 6845 - DNA, 21 bp, Artificial Sequence
  Synthetic construct
gcgcaatggtttgcgtcgcga

SEQ ID NO: 6846 - DNA, 21 bp, Artificial Sequence
  Synthetic construct
cgcaatggtttgcgtcgcgag

SEQ ID NO: 6847 - DNA, 21 bp, Artificial Sequence
  Synthetic construct
gcaatggtttgcgtcgcgagt

SEQ ID NO: 6848 - DNA, 21 bp, Artificial Sequence
  Synthetic construct
caatggtttgcgtcgcgagtt

SEQ ID NO: 6849 - DNA, 21 bp, Artificial Sequence
  Synthetic construct
aatggtttgcgtcgcgagttg

SEQ ID NO: 6850 - DNA, 21 bp, Artificial Sequence
  Synthetic construct
atggtttgcgtcgcgagttgt

SEQ ID NO: 6851 - DNA, 21 bp, Artificial Sequence
  Synthetic construct
tggtttgcgtcgcgagttgtg

SEQ ID NO: 6852 - DNA, 21 bp, Artificial Sequence
  Synthetic construct
ggtttgcgtcgcgagttgtga

SEQ ID NO: 6853 - DNA, 21 bp, Artificial Sequence
  Synthetic construct
gtttgcgtcgcgagttgtgag

SEQ ID NO: 6854 - DNA, 21 bp, Artificial Sequence
  Synthetic construct
tttgcgtcgcgagttgtgagg

SEQ ID NO: 6855 - DNA, 21 bp, Artificial Sequence
  Synthetic construct
ttgcgtcgcgagttgtgaggc

SEQ ID NO: 6856 - DNA, 21 bp, Artificial Sequence
  Synthetic construct
tgcgtcgcgagttgtgaggct

SEQ ID NO: 6857 - DNA, 21 bp, Artificial Sequence
  Synthetic construct
gcgtcgcgagttgtgaggctg

SEQ ID NO: 6858 - DNA, 21 bp, Artificial Sequence
  Synthetic construct
cgtcgcgagttgtgaggctgt

SEQ ID NO: 6859 - DNA, 21 bp, Artificial Sequence
  Synthetic construct
gtcgcgagttgtgaggctgtc

SEQ ID NO: 6860 - DNA, 21 bp, Artificial Sequence
  Synthetic construct
tcgcgagttgtgaggctgtcg

SEQ ID NO: 6861 - DNA, 21 bp, Artificial Sequence
  Synthetic construct
cgcgagttgtgaggctgtcga

SEQ ID NO: 6862 - DNA, 21 bp, Artificial Sequence
  Synthetic construct
gcgagttgtgaggctgtcgac

SEQ ID NO: 6863 - DNA, 21 bp, Artificial Sequence
  Synthetic construct
cgagttgtgaggctgtcgacc

SEQ ID NO: 6864 - DNA, 21 bp, Artificial Sequence
  Synthetic construct
gagttgtgaggctgtcgacct

SEQ ID NO: 6865 - DNA, 21 bp, Artificial Sequence
  Synthetic construct
agttgtgaggctgtcgacctg

SEQ ID NO: 6866 - DNA, 21 bp, Artificial Sequence
  Synthetic construct
gttgtgaggctgtcgacctgg

SEQ ID NO: 6867 - DNA, 21 bp, Artificial Sequence
  Synthetic construct
ttgtgaggctgtcgacctggc

SEQ ID NO: 6868 - DNA, 21 bp, Artificial Sequence
  Synthetic construct
tgtgaggctgtcgacctggcc

SEQ ID NO: 6869 - DNA, 21 bp, Artificial Sequence
  Synthetic construct
gtgaggctgtcgacctggcct

SEQ ID NO: 6870 - DNA, 21 bp, Artificial Sequence
  Synthetic construct
tgaggctgtcgacctggcctc

SEQ ID NO: 6871 - DNA, 21 bp, Artificial Sequence
  Synthetic construct
gaggctgtcgacctggcctct

SEQ ID NO: 6872 - DNA, 21 bp, Artificial Sequence
  Synthetic construct
aggctgtcgacctggcctctg

SEQ ID NO: 6873 - DNA, 21 bp, Artificial Sequence
  Synthetic construct
ggctgtcgacctggcctctgc

SEQ ID NO: 6874 - DNA, 21 bp, Artificial Sequence
  Synthetic construct
gctgtcgacctggcctctgct

SEQ ID NO: 6875 - DNA, 21 bp, Artificial Sequence
  Synthetic construct
ctgtcgacctggcctctgcta

SEQ ID NO: 6876 - DNA, 21 bp, Artificial Sequence
  Synthetic construct
tgtcgacctggcctctgctaa

SEQ ID NO: 6877 - DNA, 21 bp, Artificial Sequence
  Synthetic construct
gtcgacctggcctctgctaaa

SEQ ID NO: 6878 - DNA, 21 bp, Artificial Sequence
  Synthetic construct
tcgacctggcctctgctaaag

SEQ ID NO: 6879 - DNA, 21 bp, Artificial Sequence
  Synthetic construct
cgacctggcctctgctaaagc

SEQ ID NO: 6880 - DNA, 21 bp, Artificial Sequence
  Synthetic construct
gacctggcctctgctaaagca

SEQ ID NO: 6881 - DNA, 21 bp, Artificial Sequence
  Synthetic construct
acctggcctctgctaaagcaa

SEQ ID NO: 6882 - DNA, 21 bp, Artificial Sequence
  Synthetic construct
cctggcctctgctaaagcaac

SEQ ID NO: 6883 - DNA, 21 bp, Artificial Sequence
  Synthetic construct
ctggcctctgctaaagcaaca

SEQ ID NO: 6884 - DNA, 21 bp, Artificial Sequence
  Synthetic construct
tggcctctgctaaagcaacac

SEQ ID NO: 6885 - DNA, 21 bp, Artificial Sequence
  Synthetic construct
ggcctctgctaaagcaacacc

SEQ ID NO: 6886 - DNA, 21 bp, Artificial Sequence
  Synthetic construct
gcctctgctaaagcaacacca

SEQ ID NO: 6887 - DNA, 21 bp, Artificial Sequence
  Synthetic construct
cctctgctaaagcaacaccaa

SEQ ID NO: 6888 - DNA, 21 bp, Artificial Sequence
  Synthetic construct
ctctgctaaagcaacaccaag

SEQ ID NO: 6889 - DNA, 21 bp, Artificial Sequence
  Synthetic construct
tctgctaaagcaacaccaagg

SEQ ID NO: 6890 - DNA, 21 bp, Artificial Sequence
  Synthetic construct
ctgctaaagcaacaccaaggt

SEQ ID NO: 6891 - DNA, 21 bp, Artificial Sequence
  Synthetic construct
tgctaaagcaacaccaaggtt

SEQ ID NO: 6892 - DNA, 21 bp, Artificial Sequence
  Synthetic construct
gctaaagcaacaccaaggtta

SEQ ID NO: 6893 - DNA, 21 bp, Artificial Sequence
  Synthetic construct
ctaaagcaacaccaaggttaa

SEQ ID NO: 6894 - DNA, 21 bp, Artificial Sequence
  Synthetic construct
taaagcaacaccaaggttaaa

SEQ ID NO: 6895 - DNA, 21 bp, Artificial Sequence
  Synthetic construct
aaagcaacaccaaggttaaaa

SEQ ID NO: 6896 - DNA, 21 bp, Artificial Sequence
  Synthetic construct
aagcaacaccaaggttaaaat

SEQ ID NO: 6897 - DNA, 21 bp, Artificial Sequence
  Synthetic construct
agcaacaccaaggttaaaatt

SEQ ID NO: 6898 - DNA, 21 bp, Artificial Sequence
  Synthetic construct
gcaacaccaaggttaaaatta

SEQ ID NO: 6899 - DNA, 21 bp, Artificial Sequence
  Synthetic construct
caacaccaaggttaaaattac

SEQ ID NO: 6900 - DNA, 21 bp, Artificial Sequence
  Synthetic construct
aacaccaaggttaaaattacc

SEQ ID NO: 6901 - DNA, 21 bp, Artificial Sequence
  Synthetic construct
acaccaaggttaaaattaccc

SEQ ID NO: 6902 - DNA, 21 bp, Artificial Sequence
  Synthetic construct
caccaaggttaaaattaccct

SEQ ID NO: 6903 - DNA, 21 bp, Artificial Sequence
  Synthetic construct
accaaggttaaaattaccctg

SEQ ID NO: 6904 - DNA, 21 bp, Artificial Sequence
  Synthetic construct
ccaaggttaaaattaccctgg

SEQ ID NO: 6905 - DNA, 21 bp, Artificial Sequence
  Synthetic construct
caaggttaaaattaccctggg

SEQ ID NO: 6906 - DNA, 21 bp, Artificial Sequence
  Synthetic construct
aaggttaaaattaccctgggt

SEQ ID NO: 6907 - DNA, 21 bp, Artificial Sequence
  Synthetic construct
aggttaaaattaccctgggtg

SEQ ID NO: 6908 - DNA, 21 bp, Artificial Sequence
  Synthetic construct
ggttaaaattaccctgggtga

SEQ ID NO: 6909 - DNA, 21 bp, Artificial Sequence
  Synthetic construct
gttaaaattaccctgggtgac

SEQ ID NO: 6910 - DNA, 21 bp, Artificial Sequence
  Synthetic construct
ttaaaattaccctgggtgacc

SEQ ID NO: 6911 - DNA, 21 bp, Artificial Sequence
  Synthetic construct
taaaattaccctgggtgacct

SEQ ID NO: 6912 - DNA, 21 bp, Artificial Sequence
  Synthetic construct
aaaattaccctgggtgacctt

SEQ ID NO: 6913 - DNA, 21 bp, Artificial Sequence
  Synthetic construct
aaattaccctgggtgaccttt

SEQ ID NO: 6914 - DNA, 21 bp, Artificial Sequence
  Synthetic construct
aattaccctgggtgacctttt

SEQ ID NO: 6915 - DNA, 21 bp, Artificial Sequence
  Synthetic construct
attaccctgggtgaccttttg

SEQ ID NO: 6916 - DNA, 21 bp, Artificial Sequence
  Synthetic construct
ttaccctgggtgaccttttgc

SEQ ID NO: 6917 - DNA, 21 bp, Artificial Sequence
  Synthetic construct
taccctgggtgaccttttgca

SEQ ID NO: 6918 - DNA, 21 bp, Artificial Sequence
  Synthetic construct
accctgggtgaccttttgcag

SEQ ID NO: 6919 - DNA, 21 bp, Artificial Sequence
  Synthetic construct
ccctgggtgaccttttgcagg

SEQ ID NO: 6920 - DNA, 21 bp, Artificial Sequence
  Synthetic construct
cctgggtgaccttttgcagga

SEQ ID NO: 6921 - DNA, 21 bp, Artificial Sequence
  Synthetic construct
ctgggtgaccttttgcaggac

SEQ ID NO: 6922 - DNA, 21 bp, Artificial Sequence
  Synthetic construct
tgggtgaccttttgcaggact

SEQ ID NO: 6923 - DNA, 21 bp, Artificial Sequence
  Synthetic construct
gggtgaccttttgcaggactt

SEQ ID NO: 6924 - DNA, 21 bp, Artificial Sequence
  Synthetic construct
ggtgaccttttgcaggacttc

SEQ ID NO: 6925 - DNA, 21 bp, Artificial Sequence
  Synthetic construct
gtgaccttttgcaggacttcg

SEQ ID NO: 6926 - DNA, 21 bp, Artificial Sequence
  Synthetic construct
tgaccttttgcaggacttcgg

SEQ ID NO: 6927 - DNA, 21 bp, Artificial Sequence
  Synthetic construct
gaccttttgcaggacttcggt

SEQ ID NO: 6928 - DNA, 21 bp, Artificial Sequence
  Synthetic construct
accttttgcaggacttcggtc

SEQ ID NO: 6929 - DNA, 21 bp, Artificial Sequence
  Synthetic construct
ccttttgcaggacttcggtcg

SEQ ID NO: 6930 - DNA, 21 bp, Artificial Sequence
  Synthetic construct
cttttgcaggacttcggtcga

SEQ ID NO: 6931 - DNA, 21 bp, Artificial Sequence
  Synthetic construct
ttttgcaggacttcggtcgac

SEQ ID NO: 6932 - DNA, 21 bp, Artificial Sequence
  Synthetic construct
tttgcaggacttcggtcgacg

SEQ ID NO: 6933 - DNA, 21 bp, Artificial Sequence
  Synthetic construct
ttgcaggacttcggtcgacgc

SEQ ID NO: 6934 - DNA, 21 bp, Artificial Sequence
  Synthetic construct
tgcaggacttcggtcgacgcc

SEQ ID NO: 6935 - DNA, 21 bp, Artificial Sequence
  Synthetic construct
gcaggacttcggtcgacgccc

SEQ ID NO: 6936 - DNA, 21 bp, Artificial Sequence
  Synthetic construct
caggacttcggtcgacgcccg

SEQ ID NO: 6937 - DNA, 21 bp, Artificial Sequence
  Synthetic construct
aggacttcggtcgacgcccgg

SEQ ID NO: 6938 - DNA, 21 bp, Artificial Sequence
  Synthetic construct
ggacttcggtcgacgcccggt

SEQ ID NO: 6939 - DNA, 21 bp, Artificial Sequence
  Synthetic construct
gacttcggtcgacgcccggtt

SEQ ID NO: 6940 - DNA, 21 bp, Artificial Sequence
  Synthetic construct
acttcggtcgacgcccggttc

SEQ ID NO: 6941 - DNA, 21 bp, Artificial Sequence
  Synthetic construct
cttcggtcgacgcccggttcg

SEQ ID NO: 6942 - DNA, 21 bp, Artificial Sequence
  Synthetic construct
ttcggtcgacgcccggttcgc

SEQ ID NO: 6943 - DNA, 21 bp, Artificial Sequence
  Synthetic construct
tcggtcgacgcccggttcgca

SEQ ID NO: 6944 - DNA, 21 bp, Artificial Sequence
  Synthetic construct
cggtcgacgcccggttcgcaa

SEQ ID NO: 6945 - DNA, 21 bp, Artificial Sequence
  Synthetic construct
ggtcgacgcccggttcgcaac

SEQ ID NO: 6946 - DNA, 21 bp, Artificial Sequence
  Synthetic construct
gtcgacgcccggttcgcaacg

SEQ ID NO: 6947 - DNA, 21 bp, Artificial Sequence
  Synthetic construct
tcgacgcccggttcgcaacgt

SEQ ID NO: 6948 - DNA, 21 bp, Artificial Sequence
  Synthetic construct
cgacgcccggttcgcaacgtt

SEQ ID NO: 6949 - DNA, 21 bp, Artificial Sequence
  Synthetic construct
gacgcccggttcgcaacgttc

SEQ ID NO: 6950 - DNA, 21 bp, Artificial Sequence
  Synthetic construct
acgcccggttcgcaacgttct

SEQ ID NO: 6951 - DNA, 21 bp, Artificial Sequence
  Synthetic construct
cgcccggttcgcaacgttctg

SEQ ID NO: 6952 - DNA, 21 bp, Artificial Sequence
  Synthetic construct
gcccggttcgcaacgttctgc

SEQ ID NO: 6953 - DNA, 21 bp, Artificial Sequence
  Synthetic construct
cccggttcgcaacgttctgcg

SEQ ID NO: 6954 - DNA, 21 bp, Artificial Sequence
  Synthetic construct
ccggttcgcaacgttctgcgg

SEQ ID NO: 6955 - DNA, 21 bp, Artificial Sequence
  Synthetic construct
cggttcgcaacgttctgcggc

SEQ ID NO: 6956 - DNA, 21 bp, Artificial Sequence
  Synthetic construct
ggttcgcaacgttctgcggca

SEQ ID NO: 6957 - DNA, 21 bp, Artificial Sequence
  Synthetic construct
gttcgcaacgttctgcggcac

SEQ ID NO: 6958 - DNA, 21 bp, Artificial Sequence
  Synthetic construct
ttcgcaacgttctgcggcact

SEQ ID NO: 6959 - DNA, 21 bp, Artificial Sequence
  Synthetic construct
tcgcaacgttctgcggcactt

SEQ ID NO: 6960 - DNA, 21 bp, Artificial Sequence
  Synthetic construct
cgcaacgttctgcggcacttc

SEQ ID NO: 6961 - DNA, 21 bp, Artificial Sequence
  Synthetic construct
gcaacgttctgcggcacttcg

SEQ ID NO: 6962 - DNA, 21 bp, Artificial Sequence
  Synthetic construct
caacgttctgcggcacttcga

SEQ ID NO: 6963 - DNA, 21 bp, Artificial Sequence
  Synthetic construct
aacgttctgcggcacttcgat

SEQ ID NO: 6964 - DNA, 21 bp, Artificial Sequence
  Synthetic construct
acgttctgcggcacttcgatg

SEQ ID NO: 6965 - DNA, 21 bp, Artificial Sequence
  Synthetic construct
cgttctgcggcacttcgatgt

SEQ ID NO: 6966 - DNA, 21 bp, Artificial Sequence
  Synthetic construct
gttctgcggcacttcgatgta

SEQ ID NO: 6967 - DNA, 21 bp, Artificial Sequence
  Synthetic construct
ttctgcggcacttcgatgtaa

SEQ ID NO: 6968 - DNA, 21 bp, Artificial Sequence
  Synthetic construct
tctgcggcacttcgatgtaag

SEQ ID NO: 6969 - DNA, 21 bp, Artificial Sequence
  Synthetic construct
ctgcggcacttcgatgtaagt

SEQ ID NO: 6970 - DNA, 21 bp, Artificial Sequence
  Synthetic construct
tgcggcacttcgatgtaagtc

SEQ ID NO: 6971 - DNA, 21 bp, Artificial Sequence
  Synthetic construct
gcggcacttcgatgtaagtca

SEQ ID NO: 6972 - DNA, 21 bp, Artificial Sequence
  Synthetic construct
cggcacttcgatgtaagtcaa

SEQ ID NO: 6973 - DNA, 21 bp, Artificial Sequence
  Synthetic construct
ggcacttcgatgtaagtcaag

SEQ ID NO: 6974 - DNA, 21 bp, Artificial Sequence
  Synthetic construct
gcacttcgatgtaagtcaagt

SEQ ID NO: 6975 - DNA, 21 bp, Artificial Sequence
  Synthetic construct
cacttcgatgtaagtcaagtt

SEQ ID NO: 6976 - DNA, 21 bp, Artificial Sequence
  Synthetic construct
acttcgatgtaagtcaagttt

SEQ ID NO: 6977 - DNA, 21 bp, Artificial Sequence
  Synthetic construct
cttcgatgtaagtcaagtttt

SEQ ID NO: 6978 - DNA, 21 bp, Artificial Sequence
  Synthetic construct
ttcgatgtaagtcaagttttg

SEQ ID NO: 6979 - DNA, 21 bp, Artificial Sequence
  Synthetic construct
tcgatgtaagtcaagttttgg

SEQ ID NO: 6980 - DNA, 21 bp, Artificial Sequence
  Synthetic construct
cgatgtaagtcaagttttggc

SEQ ID NO: 6981 - DNA, 21 bp, Artificial Sequence
  Synthetic construct
gatgtaagtcaagttttggct

SEQ ID NO: 6982 - DNA, 21 bp, Artificial Sequence
  Synthetic construct
atgtaagtcaagttttggctt

SEQ ID NO: 6983 - DNA, 21 bp, Artificial Sequence
  Synthetic construct
tgtaagtcaagttttggctta

SEQ ID NO: 6984 - DNA, 21 bp, Artificial Sequence
  Synthetic construct
gtaagtcaagttttggcttac

SEQ ID NO: 6985 - DNA, 21 bp, Artificial Sequence
  Synthetic construct
taagtcaagttttggcttaca

SEQ ID NO: 6986 - DNA, 21 bp, Artificial Sequence
  Synthetic construct
aagtcaagttttggcttacag

SEQ ID NO: 6987 - DNA, 21 bp, Artificial Sequence
  Synthetic construct
agtcaagttttggcttacagg

SEQ ID NO: 6988 - DNA, 21 bp, Artificial Sequence
  Synthetic construct
gtcaagttttggcttacaggg

SEQ ID NO: 6989 - DNA, 21 bp, Artificial Sequence
  Synthetic construct
tcaagttttggcttacaggga

SEQ ID NO: 6990 - DNA, 21 bp, Artificial Sequence
  Synthetic construct
caagttttggcttacagggaa

SEQ ID NO: 6991 - DNA, 21 bp, Artificial Sequence
  Synthetic construct
aagttttggcttacagggaag

SEQ ID NO: 6992 - DNA, 21 bp, Artificial Sequence
  Synthetic construct
agttttggcttacagggaaga

SEQ ID NO: 6993 - DNA, 21 bp, Artificial Sequence
  Synthetic construct
gttttggcttacagggaagag

SEQ ID NO: 6994 - DNA, 21 bp, Artificial Sequence
  Synthetic construct
ttttggcttacagggaagagg

SEQ ID NO: 6995 - DNA, 21 bp, Artificial Sequence
  Synthetic construct
tttggcttacagggaagaggc

SEQ ID NO: 6996 - DNA, 21 bp, Artificial Sequence
  Synthetic construct
ttggcttacagggaagaggct

SEQ ID NO: 6997 - DNA, 21 bp, Artificial Sequence
  Synthetic construct
tggcttacagggaagaggctg

SEQ ID NO: 6998 - DNA, 21 bp, Artificial Sequence
  Synthetic construct
ggcttacagggaagaggctgt

SEQ ID NO: 6999 - DNA, 21 bp, Artificial Sequence
  Synthetic construct
gcttacagggaagaggctgta

SEQ ID NO: 7000 - DNA, 21 bp, Artificial Sequence
  Synthetic construct
cttacagggaagaggctgtag

SEQ ID NO: 7001 - DNA, 21 bp, Artificial Sequence
  Synthetic construct
ttacagggaagaggctgtagc

SEQ ID NO: 7002 - DNA, 21 bp, Artificial Sequence
  Synthetic construct
tacagggaagaggctgtagca

SEQ ID NO: 7003 - DNA, 21 bp, Artificial Sequence
  Synthetic construct
acagggaagaggctgtagcag

SEQ ID NO: 7004 - DNA, 21 bp, Artificial Sequence
  Synthetic construct
cagggaagaggctgtagcagg

SEQ ID NO: 7005 - DNA, 21 bp, Artificial Sequence
  Synthetic construct
agggaagaggctgtagcagga

SEQ ID NO: 7006 - DNA, 21 bp, Artificial Sequence
  Synthetic construct
gggaagaggctgtagcaggag

SEQ ID NO: 7007 - DNA, 21 bp, Artificial Sequence
  Synthetic construct
ggaagaggctgtagcaggagc

SEQ ID NO: 7008 - DNA, 21 bp, Artificial Sequence
  Synthetic construct
gaagaggctgtagcaggagcg

SEQ ID NO: 7009 - DNA, 21 bp, Artificial Sequence
  Synthetic construct
aagaggctgtagcaggagcgt

SEQ ID NO: 7010 - DNA, 21 bp, Artificial Sequence
  Synthetic construct
agaggctgtagcaggagcgtg

SEQ ID NO: 7011 - DNA, 21 bp, Artificial Sequence
  Synthetic construct
gaggctgtagcaggagcgtgc

SEQ ID NO: 7012 - DNA, 21 bp, Artificial Sequence
  Synthetic construct
aggctgtagcaggagcgtgcg

SEQ ID NO: 7013 - DNA, 21 bp, Artificial Sequence
  Synthetic construct
ggctgtagcaggagcgtgcgt

SEQ ID NO: 7014 - DNA, 21 bp, Artificial Sequence
  Synthetic construct
gctgtagcaggagcgtgcgtc

SEQ ID NO: 7015 - DNA, 21 bp, Artificial Sequence
  Synthetic construct
ctgtagcaggagcgtgcgtcg

SEQ ID NO: 7016 - DNA, 21 bp, Artificial Sequence
  Synthetic construct
tgtagcaggagcgtgcgtcga

SEQ ID NO: 7017 - DNA, 21 bp, Artificial Sequence
  Synthetic construct
gtagcaggagcgtgcgtcgag

SEQ ID NO: 7018 - DNA, 21 bp, Artificial Sequence
  Synthetic construct
tagcaggagcgtgcgtcgagg

SEQ ID NO: 7019 - DNA, 21 bp, Artificial Sequence
  Synthetic construct
agcaggagcgtgcgtcgaggg

SEQ ID NO: 7020 - DNA, 21 bp, Artificial Sequence
  Synthetic construct
gcaggagcgtgcgtcgaggga

SEQ ID NO: 7021 - DNA, 21 bp, Artificial Sequence
  Synthetic construct
caggagcgtgcgtcgagggag

SEQ ID NO: 7022 - DNA, 21 bp, Artificial Sequence
  Synthetic construct
aggagcgtgcgtcgagggaga

SEQ ID NO: 7023 - DNA, 21 bp, Artificial Sequence
  Synthetic construct
ggagcgtgcgtcgagggagaa

SEQ ID NO: 7024 - DNA, 21 bp, Artificial Sequence
  Synthetic construct
gagcgtgcgtcgagggagaag

SEQ ID NO: 7025 - DNA, 21 bp, Artificial Sequence
  Synthetic construct
agcgtgcgtcgagggagaagc

SEQ ID NO: 7026 - DNA, 21 bp, Artificial Sequence
  Synthetic construct
gcgtgcgtcgagggagaagcc

SEQ ID NO: 7027 - DNA, 21 bp, Artificial Sequence
  Synthetic construct
cgtgcgtcgagggagaagccg

SEQ ID NO: 7028 - DNA, 21 bp, Artificial Sequence
  Synthetic construct
gtgcgtcgagggagaagccga

SEQ ID NO: 7029 - DNA, 21 bp, Artificial Sequence
  Synthetic construct
tgcgtcgagggagaagccgaa

SEQ ID NO: 7030 - DNA, 21 bp, Artificial Sequence
  Synthetic construct
gcgtcgagggagaagccgaaa

SEQ ID NO: 7031 - DNA, 21 bp, Artificial Sequence
  Synthetic construct
cgtcgagggagaagccgaaac

SEQ ID NO: 7032 - DNA, 21 bp, Artificial Sequence
  Synthetic construct
gtcgagggagaagccgaaacc

SEQ ID NO: 7033 - DNA, 21 bp, Artificial Sequence
  Synthetic construct
tcgagggagaagccgaaaccg

SEQ ID NO: 7034 - DNA, 21 bp, Artificial Sequence
  Synthetic construct
cgagggagaagccgaaaccgg

SEQ ID NO: 7035 - DNA, 21 bp, Artificial Sequence
  Synthetic construct
gagggagaagccgaaaccggc

SEQ ID NO: 7036 - DNA, 21 bp, Artificial Sequence
  Synthetic construct
agggagaagccgaaaccggct

SEQ ID NO: 7037 - DNA, 21 bp, Artificial Sequence
  Synthetic construct
gggagaagccgaaaccggctt

SEQ ID NO: 7038 - DNA, 21 bp, Artificial Sequence
  Synthetic construct
ggagaagccgaaaccggcttt

SEQ ID NO: 7039 - DNA, 21 bp, Artificial Sequence
  Synthetic construct
gagaagccgaaaccggctttc

SEQ ID NO: 7040 - DNA, 21 bp, Artificial Sequence
  Synthetic construct
agaagccgaaaccggctttct

SEQ ID NO: 7041 - DNA, 21 bp, Artificial Sequence
  Synthetic construct
gaagccgaaaccggctttctc

SEQ ID NO: 7042 - DNA, 21 bp, Artificial Sequence
  Synthetic construct
aagccgaaaccggctttctcc

SEQ ID NO: 7043 - DNA, 21 bp, Artificial Sequence
  Synthetic construct
agccgaaaccggctttctcct

SEQ ID NO: 7044 - DNA, 21 bp, Artificial Sequence
  Synthetic construct
gccgaaaccggctttctcctc

SEQ ID NO: 7045 - DNA, 21 bp, Artificial Sequence
  Synthetic construct
ccgaaaccggctttctcctcg

SEQ ID NO: 7046 - DNA, 21 bp, Artificial Sequence
  Synthetic construct
cgaaaccggctttctcctcgt

SEQ ID NO: 7047 - DNA, 21 bp, Artificial Sequence
  Synthetic construct
gaaaccggctttctcctcgta

SEQ ID NO: 7048 - DNA, 21 bp, Artificial Sequence
  Synthetic construct
aaaccggctttctcctcgtac

SEQ ID NO: 7049 - DNA, 21 bp, Artificial Sequence
  Synthetic construct
aaccggctttctcctcgtacg

SEQ ID NO: 7050 - DNA, 21 bp, Artificial Sequence
  Synthetic construct
accggctttctcctcgtacgg

SEQ ID NO: 7051 - DNA, 21 bp, Artificial Sequence
  Synthetic construct
ccggctttctcctcgtacggg

SEQ ID NO: 7052 - DNA, 21 bp, Artificial Sequence
  Synthetic construct
cggctttctcctcgtacgggc

SEQ ID NO: 7053 - DNA, 21 bp, Artificial Sequence
  Synthetic construct
ggctttctcctcgtacgggcg

SEQ ID NO: 7054 - DNA, 21 bp, Artificial Sequence
  Synthetic construct
gctttctcctcgtacgggcga

SEQ ID NO: 7055 - DNA, 21 bp, Artificial Sequence
  Synthetic construct
ctttctcctcgtacgggcgac

SEQ ID NO: 7056 - DNA, 21 bp, Artificial Sequence
  Synthetic construct
tttctcctcgtacgggcgacc

SEQ ID NO: 7057 - DNA, 21 bp, Artificial Sequence
  Synthetic construct
ttctcctcgtacgggcgaccc

SEQ ID NO: 7058 - DNA, 21 bp, Artificial Sequence
  Synthetic construct
tctcctcgtacgggcgacccc

SEQ ID NO: 7059 - DNA, 21 bp, Artificial Sequence
  Synthetic construct
ctcctcgtacgggcgacccca

SEQ ID NO: 7060 - DNA, 21 bp, Artificial Sequence
  Synthetic construct
tcctcgtacgggcgaccccac

SEQ ID NO: 7061 - DNA, 21 bp, Artificial Sequence
  Synthetic construct
cctcgtacgggcgaccccacg

SEQ ID NO: 7062 - DNA, 21 bp, Artificial Sequence
  Synthetic construct
ctcgtacgggcgaccccacga

SEQ ID NO: 7063 - DNA, 21 bp, Artificial Sequence
  Synthetic construct
tcgtacgggcgaccccacgat

SEQ ID NO: 7064 - DNA, 21 bp, Artificial Sequence
  Synthetic construct
cgtacgggcgaccccacgatg

SEQ ID NO: 7065 - DNA, 21 bp, Artificial Sequence
  Synthetic construct
gtacgggcgaccccacgatga

SEQ ID NO: 7066 - DNA, 21 bp, Artificial Sequence
  Synthetic construct
tacgggcgaccccacgatgac

SEQ ID NO: 7067 - DNA, 21 bp, Artificial Sequence
  Synthetic construct
acgggcgaccccacgatgacc

SEQ ID NO: 7068 - DNA, 21 bp, Artificial Sequence
  Synthetic construct
cgggcgaccccacgatgaccc

SEQ ID NO: 7069 - DNA, 21 bp, Artificial Sequence
  Synthetic construct
gggcgaccccacgatgaccca

SEQ ID NO: 7070 - DNA, 21 bp, Artificial Sequence
  Synthetic construct
ggcgaccccacgatgacccac

SEQ ID NO: 7071 - DNA, 21 bp, Artificial Sequence
  Synthetic construct
gcgaccccacgatgacccact

SEQ ID NO: 7072 - DNA, 21 bp, Artificial Sequence
  Synthetic construct
cgaccccacgatgacccactt

SEQ ID NO: 7073 - DNA, 21 bp, Artificial Sequence
  Synthetic construct
gaccccacgatgacccacttc

SEQ ID NO: 7074 - DNA, 21 bp, Artificial Sequence
  Synthetic construct
accccacgatgacccacttcg

SEQ ID NO: 7075 - DNA, 21 bp, Artificial Sequence
  Synthetic construct
ccccacgatgacccacttcgc

SEQ ID NO: 7076 - DNA, 21 bp, Artificial Sequence
  Synthetic construct
cccacgatgacccacttcgct

SEQ ID NO: 7077 - DNA, 21 bp, Artificial Sequence
  Synthetic construct
ccacgatgacccacttcgctt

SEQ ID NO: 7078 - DNA, 21 bp, Artificial Sequence
  Synthetic construct
cacgatgacccacttcgcttg

SEQ ID NO: 7079 - DNA, 21 bp, Artificial Sequence
  Synthetic construct
acgatgacccacttcgcttgt

SEQ ID NO: 7080 - DNA, 21 bp, Artificial Sequence
  Synthetic construct
cgatgacccacttcgcttgta

SEQ ID NO: 7081 - DNA, 21 bp, Artificial Sequence
  Synthetic construct
gatgacccacttcgcttgtag

SEQ ID NO: 7082 - DNA, 21 bp, Artificial Sequence
  Synthetic construct
atgacccacttcgcttgtagg

SEQ ID NO: 7083 - DNA, 21 bp, Artificial Sequence
  Synthetic construct
tgacccacttcgcttgtaggc

SEQ ID NO: 7084 - DNA, 21 bp, Artificial Sequence
  Synthetic construct
gacccacttcgcttgtaggca

SEQ ID NO: 7085 - DNA, 21 bp, Artificial Sequence
  Synthetic construct
acccacttcgcttgtaggcac

SEQ ID NO: 7086 - DNA, 21 bp, Artificial Sequence
  Synthetic construct
cccacttcgcttgtaggcacc

SEQ ID NO: 7087 - DNA, 21 bp, Artificial Sequence
  Synthetic construct
ccacttcgcttgtaggcacct

SEQ ID NO: 7088 - DNA, 21 bp, Artificial Sequence
  Synthetic construct
cacttcgcttgtaggcacctt

SEQ ID NO: 7089 - DNA, 21 bp, Artificial Sequence
  Synthetic construct
acttcgcttgtaggcaccttg

SEQ ID NO: 7090 - DNA, 21 bp, Artificial Sequence
  Synthetic construct
cttcgcttgtaggcaccttga

SEQ ID NO: 7091 - DNA, 21 bp, Artificial Sequence
  Synthetic construct
ttcgcttgtaggcaccttgat

SEQ ID NO: 7092 - DNA, 21 bp, Artificial Sequence
  Synthetic construct
tcgcttgtaggcaccttgatc

SEQ ID NO: 7093 - DNA, 21 bp, Artificial Sequence
  Synthetic construct
cgcttgtaggcaccttgatct

SEQ ID NO: 7094 - DNA, 21 bp, Artificial Sequence
  Synthetic construct
gcttgtaggcaccttgatcta

SEQ ID NO: 7095 - DNA, 21 bp, Artificial Sequence
  Synthetic construct
cttgtaggcaccttgatctat

SEQ ID NO: 7096 - DNA, 21 bp, Artificial Sequence
  Synthetic construct
ttgtaggcaccttgatctatc

SEQ ID NO: 7097 - DNA, 21 bp, Artificial Sequence
  Synthetic construct
tgtaggcaccttgatctatcg

SEQ ID NO: 7098 - DNA, 21 bp, Artificial Sequence
  Synthetic construct
gtaggcaccttgatctatcga

SEQ ID NO: 7099 - DNA, 21 bp, Artificial Sequence
  Synthetic construct
taggcaccttgatctatcgat

SEQ ID NO: 7100 - DNA, 21 bp, Artificial Sequence
  Synthetic construct
aggcaccttgatctatcgatg

SEQ ID NO: 7101 - DNA, 21 bp, Artificial Sequence
  Synthetic construct
ggcaccttgatctatcgatgt

SEQ ID NO: 7102 - DNA, 21 bp, Artificial Sequence
  Synthetic construct
gcaccttgatctatcgatgtg

SEQ ID NO: 7103 - DNA, 21 bp, Artificial Sequence
  Synthetic construct
caccttgatctatcgatgtga

SEQ ID NO: 7104 - DNA, 21 bp, Artificial Sequence
  Synthetic construct
accttgatctatcgatgtgac

SEQ ID NO: 7105 - DNA, 21 bp, Artificial Sequence
  Synthetic construct
ccttgatctatcgatgtgaca

SEQ ID NO: 7106 - DNA, 21 bp, Artificial Sequence
  Synthetic construct
cttgatctatcgatgtgacac

SEQ ID NO: 7107 - DNA, 21 bp, Artificial Sequence
  Synthetic construct
ttgatctatcgatgtgacact

SEQ ID NO: 7108 - DNA, 21 bp, Artificial Sequence
  Synthetic construct
tgatctatcgatgtgacactt

SEQ ID NO: 7109 - DNA, 21 bp, Artificial Sequence
  Synthetic construct
gatctatcgatgtgacactta

SEQ ID NO: 7110 - DNA, 21 bp, Artificial Sequence
  Synthetic construct
atctatcgatgtgacacttaa

SEQ ID NO: 7111 - DNA, 21 bp, Artificial Sequence
  Synthetic construct
tctatcgatgtgacacttaac

SEQ ID NO: 7112 - DNA, 21 bp, Artificial Sequence
  Synthetic construct
ctatcgatgtgacacttaacg

SEQ ID NO: 7113 - DNA, 21 bp, Artificial Sequence
  Synthetic construct
tatcgatgtgacacttaacgc

SEQ ID NO: 7114 - DNA, 21 bp, Artificial Sequence
  Synthetic construct
atcgatgtgacacttaacgcc

SEQ ID NO: 7115 - DNA, 21 bp, Artificial Sequence
  Synthetic construct
tcgatgtgacacttaacgccc

SEQ ID NO: 7116 - DNA, 21 bp, Artificial Sequence
  Synthetic construct
cgatgtgacacttaacgcccc

SEQ ID NO: 7117 - DNA, 21 bp, Artificial Sequence
  Synthetic construct
gatgtgacacttaacgccccc

SEQ ID NO: 7118 - DNA, 21 bp, Artificial Sequence
  Synthetic construct
atgtgacacttaacgcccccc

SEQ ID NO: 7119 - DNA, 21 bp, Artificial Sequence
  Synthetic construct
tgtgacacttaacgccccccg

SEQ ID NO: 7120 - DNA, 21 bp, Artificial Sequence
  Synthetic construct
gtgacacttaacgccccccgt

SEQ ID NO: 7121 - DNA, 21 bp, Artificial Sequence
  Synthetic construct
tgacacttaacgccccccgtg

SEQ ID NO: 7122 - DNA, 21 bp, Artificial Sequence
  Synthetic construct
gacacttaacgccccccgtga

SEQ ID NO: 7123 - DNA, 21 bp, Artificial Sequence
  Synthetic construct
acacttaacgccccccgtgaa

SEQ ID NO: 7124 - DNA, 21 bp, Artificial Sequence
  Synthetic construct
cacttaacgccccccgtgaat

SEQ ID NO: 7125 - DNA, 21 bp, Artificial Sequence
  Synthetic construct
acttaacgccccccgtgaata

SEQ ID NO: 7126 - DNA, 21 bp, Artificial Sequence
  Synthetic construct
cttaacgccccccgtgaatac

SEQ ID NO: 7127 - DNA, 21 bp, Artificial Sequence
  Synthetic construct
ttaacgccccccgtgaatacg

SEQ ID NO: 7128 - DNA, 21 bp, Artificial Sequence
  Synthetic construct
taacgccccccgtgaatacgg

SEQ ID NO: 7129 - DNA, 21 bp, Artificial Sequence
  Synthetic construct
aacgccccccgtgaatacgga

SEQ ID NO: 7130 - DNA, 21 bp, Artificial Sequence
  Synthetic construct
acgccccccgtgaatacggag

SEQ ID NO: 7131 - DNA, 21 bp, Artificial Sequence
  Synthetic construct
cgccccccgtgaatacggaga

SEQ ID NO: 7132 - DNA, 21 bp, Artificial Sequence
  Synthetic construct
gccccccgtgaatacggagag

SEQ ID NO: 7133 - DNA, 21 bp, Artificial Sequence
  Synthetic construct
ccccccgtgaatacggagagg

SEQ ID NO: 7134 - DNA, 21 bp, Artificial Sequence
  Synthetic construct
cccccgtgaatacggagaggg

SEQ ID NO: 7135 - DNA, 21 bp, Artificial Sequence
  Synthetic construct
ccccgtgaatacggagagggg

SEQ ID NO: 7136 - DNA, 21 bp, Artificial Sequence
  Synthetic construct
cccgtgaatacggagaggggt

SEQ ID NO: 7137 - DNA, 21 bp, Artificial Sequence
  Synthetic construct
ccgtgaatacggagaggggta

SEQ ID NO: 7138 - DNA, 21 bp, Artificial Sequence
  Synthetic construct
cgtgaatacggagaggggtag

SEQ ID NO: 7139 - DNA, 21 bp, Artificial Sequence
  Synthetic construct
gtgaatacggagaggggtagt

SEQ ID NO: 7140 - DNA, 21 bp, Artificial Sequence
  Synthetic construct
tgaatacggagaggggtagtg

SEQ ID NO: 7141 - DNA, 21 bp, Artificial Sequence
  Synthetic construct
gaatacggagaggggtagtgc

SEQ ID NO: 7142 - DNA, 21 bp, Artificial Sequence
  Synthetic construct
aatacggagaggggtagtgcc

SEQ ID NO: 7143 - DNA, 21 bp, Artificial Sequence
  Synthetic construct
atacggagaggggtagtgcca

SEQ ID NO: 7144 - DNA, 21 bp, Artificial Sequence
  Synthetic construct
tacggagaggggtagtgccac

SEQ ID NO: 7145 - DNA, 21 bp, Artificial Sequence
  Synthetic construct
acggagaggggtagtgccact

SEQ ID NO: 7146 - DNA, 21 bp, Artificial Sequence
  Synthetic construct
cggagaggggtagtgccactg

SEQ ID NO: 7147 - DNA, 21 bp, Artificial Sequence
  Synthetic construct
ggagaggggtagtgccactgt

SEQ ID NO: 7148 - DNA, 21 bp, Artificial Sequence
  Synthetic construct
gagaggggtagtgccactgtt

SEQ ID NO: 7149 - DNA, 21 bp, Artificial Sequence
  Synthetic construct
agaggggtagtgccactgttt

SEQ ID NO: 7150 - DNA, 21 bp, Artificial Sequence
  Synthetic construct
gaggggtagtgccactgtttc

SEQ ID NO: 7151 - DNA, 21 bp, Artificial Sequence
  Synthetic construct
aggggtagtgccactgtttcg

SEQ ID NO: 7152 - DNA, 21 bp, Artificial Sequence
  Synthetic construct
ggggtagtgccactgtttcgt

SEQ ID NO: 7153 - DNA, 21 bp, Artificial Sequence
  Synthetic construct
gggtagtgccactgtttcgtt

SEQ ID NO: 7154 - DNA, 21 bp, Artificial Sequence
  Synthetic construct
ggtagtgccactgtttcgttt

SEQ ID NO: 7155 - DNA, 21 bp, Artificial Sequence
  Synthetic construct
gtagtgccactgtttcgtttt

SEQ ID NO: 7156 - DNA, 21 bp, Artificial Sequence
  Synthetic construct
tagtgccactgtttcgttttg

SEQ ID NO: 7157 - DNA, 21 bp, Artificial Sequence
  Synthetic construct
agtgccactgtttcgttttgg

SEQ ID NO: 7158 - DNA, 21 bp, Artificial Sequence
  Synthetic construct
gtgccactgtttcgttttggc

SEQ ID NO: 7159 - DNA, 21 bp, Artificial Sequence
  Synthetic construct
tgccactgtttcgttttggcc

SEQ ID NO: 7160 - DNA, 21 bp, Artificial Sequence
  Synthetic construct
gccactgtttcgttttggccc

SEQ ID NO: 7161 - DNA, 21 bp, Artificial Sequence
  Synthetic construct
ccactgtttcgttttggcccc

SEQ ID NO: 7162 - DNA, 21 bp, Artificial Sequence
  Synthetic construct
cactgtttcgttttggcccca

SEQ ID NO: 7163 - DNA, 21 bp, Artificial Sequence
  Synthetic construct
actgtttcgttttggccccag

SEQ ID NO: 7164 - DNA, 21 bp, Artificial Sequence
  Synthetic construct
ctgtttcgttttggccccagt

SEQ ID NO: 7165 - DNA, 21 bp, Artificial Sequence
  Synthetic construct
tgtttcgttttggccccagtc

SEQ ID NO: 7166 - DNA, 21 bp, Artificial Sequence
  Synthetic construct
gtttcgttttggccccagtcg

SEQ ID NO: 7167 - DNA, 21 bp, Artificial Sequence
  Synthetic construct
tttcgttttggccccagtcga

SEQ ID NO: 7168 - DNA, 21 bp, Artificial Sequence
  Synthetic construct
ttcgttttggccccagtcgag

SEQ ID NO: 7169 - DNA, 21 bp, Artificial Sequence
  Synthetic construct
tcgttttggccccagtcgagt

SEQ ID NO: 7170 - DNA, 21 bp, Artificial Sequence
  Synthetic construct
cgttttggccccagtcgagtt

SEQ ID NO: 7171 - DNA, 21 bp, Artificial Sequence
  Synthetic construct
gttttggccccagtcgagtta

SEQ ID NO: 7172 - DNA, 21 bp, Artificial Sequence
  Synthetic construct
ttttggccccagtcgagttaa

SEQ ID NO: 7173 - DNA, 21 bp, Artificial Sequence
  Synthetic construct
tttggccccagtcgagttaaa

SEQ ID NO: 7174 - DNA, 21 bp, Artificial Sequence
  Synthetic construct
ttggccccagtcgagttaaaa

SEQ ID NO: 7175 - DNA, 21 bp, Artificial Sequence
  Synthetic construct
tggccccagtcgagttaaaac

SEQ ID NO: 7176 - DNA, 21 bp, Artificial Sequence
  Synthetic construct
ggccccagtcgagttaaaacg

SEQ ID NO: 7177 - DNA, 21 bp, Artificial Sequence
  Synthetic construct
gccccagtcgagttaaaacga

SEQ ID NO: 7178 - DNA, 21 bp, Artificial Sequence
  Synthetic construct
ccccagtcgagttaaaacgac

SEQ ID NO: 7179 - DNA, 21 bp, Artificial Sequence
  Synthetic construct
cccagtcgagttaaaacgacc

SEQ ID NO: 7180 - DNA, 21 bp, Artificial Sequence
  Synthetic construct
ccagtcgagttaaaacgaccg

SEQ ID NO: 7181 - DNA, 21 bp, Artificial Sequence
  Synthetic construct
cagtcgagttaaaacgaccgg

SEQ ID NO: 7182 - DNA, 21 bp, Artificial Sequence
  Synthetic construct
agtcgagttaaaacgaccggg

SEQ ID NO: 7183 - DNA, 21 bp, Artificial Sequence
  Synthetic construct
gtcgagttaaaacgaccggga

SEQ ID NO: 7184 - DNA, 21 bp, Artificial Sequence
  Synthetic construct
tcgagttaaaacgaccgggag

SEQ ID NO: 7185 - DNA, 21 bp, Artificial Sequence
  Synthetic construct
cgagttaaaacgaccgggagt

SEQ ID NO: 7186 - DNA, 21 bp, Artificial Sequence
  Synthetic construct
gagttaaaacgaccgggagtc

SEQ ID NO: 7187 - DNA, 21 bp, Artificial Sequence
  Synthetic construct
agttaaaacgaccgggagtcc

SEQ ID NO: 7188 - DNA, 21 bp, Artificial Sequence
  Synthetic construct
gttaaaacgaccgggagtcca

SEQ ID NO: 7189 - DNA, 21 bp, Artificial Sequence
  Synthetic construct
ttaaaacgaccgggagtccag

SEQ ID NO: 7190 - DNA, 21 bp, Artificial Sequence
  Synthetic construct
taaaacgaccgggagtccagt

SEQ ID NO: 7191 - DNA, 21 bp, Artificial Sequence
  Synthetic construct
aaaacgaccgggagtccagtt

SEQ ID NO: 7192 - DNA, 21 bp, Artificial Sequence
  Synthetic construct
aaacgaccgggagtccagttc

SEQ ID NO: 7193 - DNA, 21 bp, Artificial Sequence
  Synthetic construct
aacgaccgggagtccagttcg

SEQ ID NO: 7194 - DNA, 21 bp, Artificial Sequence
  Synthetic construct
acgaccgggagtccagttcga

SEQ ID NO: 7195 - DNA, 21 bp, Artificial Sequence
  Synthetic construct
cgaccgggagtccagttcgaa

SEQ ID NO: 7196 - DNA, 21 bp, Artificial Sequence
  Synthetic construct
gaccgggagtccagttcgaac

SEQ ID NO: 7197 - DNA, 21 bp, Artificial Sequence
  Synthetic construct
accgggagtccagttcgaacg

SEQ ID NO: 7198 - DNA, 21 bp, Artificial Sequence
  Synthetic construct
ccgggagtccagttcgaacga

SEQ ID NO: 7199 - DNA, 21 bp, Artificial Sequence
  Synthetic construct
cgggagtccagttcgaacgat

SEQ ID NO: 7200 - DNA, 21 bp, Artificial Sequence
  Synthetic construct
gggagtccagttcgaacgata

SEQ ID NO: 7201 - DNA, 21 bp, Artificial Sequence
  Synthetic construct
ggagtccagttcgaacgatat

SEQ ID NO: 7202 - DNA, 21 bp, Artificial Sequence
  Synthetic construct
gagtccagttcgaacgatatt

SEQ ID NO: 7203 - DNA, 21 bp, Artificial Sequence
  Synthetic construct
agtccagttcgaacgatattt

SEQ ID NO: 7204 - DNA, 21 bp, Artificial Sequence
  Synthetic construct
gtccagttcgaacgatatttt

SEQ ID NO: 7205 - DNA, 21 bp, Artificial Sequence
  Synthetic construct
tccagttcgaacgatatttta

SEQ ID NO: 7206 - DNA, 21 bp, Artificial Sequence
  Synthetic construct
ccagttcgaacgatattttaa

SEQ ID NO: 7207 - DNA, 21 bp, Artificial Sequence
  Synthetic construct
cagttcgaacgatattttaaa

SEQ ID NO: 7208 - DNA, 21 bp, Artificial Sequence
  Synthetic construct
agttcgaacgatattttaaag

SEQ ID NO: 7209 - DNA, 21 bp, Artificial Sequence
  Synthetic construct
gttcgaacgatattttaaaga

SEQ ID NO: 7210 - DNA, 21 bp, Artificial Sequence
  Synthetic construct
ttcgaacgatattttaaagag

SEQ ID NO: 7211 - DNA, 21 bp, Artificial Sequence
  Synthetic construct
tcgaacgatattttaaagaga

SEQ ID NO: 7212 - DNA, 21 bp, Artificial Sequence
  Synthetic construct
cgaacgatattttaaagagaa

SEQ ID NO: 7213 - DNA, 21 bp, Artificial Sequence
  Synthetic construct
gaacgatattttaaagagaat

SEQ ID NO: 7214 - DNA, 21 bp, Artificial Sequence
  Synthetic construct
aacgatattttaaagagaatg

SEQ ID NO: 7215 - DNA, 21 bp, Artificial Sequence
  Synthetic construct
acgatattttaaagagaatga

SEQ ID NO: 7216 - DNA, 21 bp, Artificial Sequence
  Synthetic construct
cgatattttaaagagaatgag

SEQ ID NO: 7217 - DNA, 21 bp, Artificial Sequence
  Synthetic construct
gatattttaaagagaatgagt

SEQ ID NO: 7218 - DNA, 21 bp, Artificial Sequence
  Synthetic construct
atattttaaagagaatgagtt

SEQ ID NO: 7219 - DNA, 21 bp, Artificial Sequence
  Synthetic construct
tattttaaagagaatgagtta

SEQ ID NO: 7220 - DNA, 21 bp, Artificial Sequence
  Synthetic construct
attttaaagagaatgagttat

SEQ ID NO: 7221 - DNA, 21 bp, Artificial Sequence
  Synthetic construct
ttttaaagagaatgagttatc

SEQ ID NO: 7222 - DNA, 21 bp, Artificial Sequence
  Synthetic construct
tttaaagagaatgagttatct

SEQ ID NO: 7223 - DNA, 21 bp, Artificial Sequence
  Synthetic construct
ttaaagagaatgagttatctt

SEQ ID NO: 7224 - DNA, 21 bp, Artificial Sequence
  Synthetic construct
taaagagaatgagttatcttc

SEQ ID NO: 7225 - DNA, 21 bp, Artificial Sequence
  Synthetic construct
aaagagaatgagttatcttca

SEQ ID NO: 7226 - DNA, 21 bp, Artificial Sequence
  Synthetic construct
aagagaatgagttatcttcag

SEQ ID NO: 7227 - DNA, 21 bp, Artificial Sequence
  Synthetic construct
agagaatgagttatcttcagt

SEQ ID NO: 7228 - DNA, 21 bp, Artificial Sequence
  Synthetic construct
gagaatgagttatcttcagtc

SEQ ID NO: 7229 - DNA, 21 bp, Artificial Sequence
  Synthetic construct
agaatgagttatcttcagtct

SEQ ID NO: 7230 - DNA, 21 bp, Artificial Sequence
  Synthetic construct
gaatgagttatcttcagtctc

SEQ ID NO: 7231 - DNA, 21 bp, Artificial Sequence
  Synthetic construct
aatgagttatcttcagtctca

SEQ ID NO: 7232 - DNA, 21 bp, Artificial Sequence
  Synthetic construct
atgagttatcttcagtctcac

SEQ ID NO: 7233 - DNA, 21 bp, Artificial Sequence
  Synthetic construct
tgagttatcttcagtctcacc

SEQ ID NO: 7234 - DNA, 21 bp, Artificial Sequence
  Synthetic construct
gagttatcttcagtctcaccg

SEQ ID NO: 7235 - DNA, 21 bp, Artificial Sequence
  Synthetic construct
agttatcttcagtctcaccgt

SEQ ID NO: 7236 - DNA, 21 bp, Artificial Sequence
  Synthetic construct
gttatcttcagtctcaccgtc

SEQ ID NO: 7237 - DNA, 21 bp, Artificial Sequence
  Synthetic construct
ttatcttcagtctcaccgtcc

SEQ ID NO: 7238 - DNA, 21 bp, Artificial Sequence
  Synthetic construct
tatcttcagtctcaccgtccg

SEQ ID NO: 7239 - DNA, 21 bp, Artificial Sequence
  Synthetic construct
atcttcagtctcaccgtccgc

SEQ ID NO: 7240 - DNA, 21 bp, Artificial Sequence
  Synthetic construct
tcttcagtctcaccgtccgcg

SEQ ID NO: 7241 - DNA, 21 bp, Artificial Sequence
  Synthetic construct
cttcagtctcaccgtccgcgt

SEQ ID NO: 7242 - DNA, 21 bp, Artificial Sequence
  Synthetic construct
ttcagtctcaccgtccgcgta

SEQ ID NO: 7243 - DNA, 21 bp, Artificial Sequence
  Synthetic construct
tcagtctcaccgtccgcgtaa

SEQ ID NO: 7244 - DNA, 21 bp, Artificial Sequence
  Synthetic construct
cagtctcaccgtccgcgtaaa

SEQ ID NO: 7245 - DNA, 21 bp, Artificial Sequence
  Synthetic construct
agtctcaccgtccgcgtaaac

SEQ ID NO: 7246 - DNA, 21 bp, Artificial Sequence
  Synthetic construct
gtctcaccgtccgcgtaaacg

SEQ ID NO: 7247 - DNA, 21 bp, Artificial Sequence
  Synthetic construct
tctcaccgtccgcgtaaacgc

SEQ ID NO: 7248 - DNA, 21 bp, Artificial Sequence
  Synthetic construct
ctcaccgtccgcgtaaacgcg

SEQ ID NO: 7249 - DNA, 21 bp, Artificial Sequence
  Synthetic construct
tcaccgtccgcgtaaacgcga

SEQ ID NO: 7250 - DNA, 21 bp, Artificial Sequence
  Synthetic construct
caccgtccgcgtaaacgcgaa

SEQ ID NO: 7251 - DNA, 21 bp, Artificial Sequence
  Synthetic construct
accgtccgcgtaaacgcgaac

SEQ ID NO: 7252 - DNA, 21 bp, Artificial Sequence
  Synthetic construct
ccgtccgcgtaaacgcgaacg

SEQ ID NO: 7253 - DNA, 21 bp, Artificial Sequence
  Synthetic construct
cgtccgcgtaaacgcgaacgg

SEQ ID NO: 7254 - DNA, 21 bp, Artificial Sequence
  Synthetic construct
gtccgcgtaaacgcgaacgga

SEQ ID NO: 7255 - DNA, 21 bp, Artificial Sequence
  Synthetic construct
tccgcgtaaacgcgaacggag

SEQ ID NO: 7256 - DNA, 21 bp, Artificial Sequence
  Synthetic construct
ccgcgtaaacgcgaacggagg

SEQ ID NO: 7257 - DNA, 21 bp, Artificial Sequence
  Synthetic construct
cgcgtaaacgcgaacggaggg

SEQ ID NO: 7258 - DNA, 21 bp, Artificial Sequence
  Synthetic construct
gcgtaaacgcgaacggagggg

SEQ ID NO: 7259 - DNA, 21 bp, Artificial Sequence
  Synthetic construct
cgtaaacgcgaacggagggga

SEQ ID NO: 7260 - DNA, 21 bp, Artificial Sequence
  Synthetic construct
gtaaacgcgaacggaggggac

SEQ ID NO: 7261 - DNA, 21 bp, Artificial Sequence
  Synthetic construct
taaacgcgaacggaggggacg

SEQ ID NO: 7262 - DNA, 21 bp, Artificial Sequence
  Synthetic construct
aaacgcgaacggaggggacga

SEQ ID NO: 7263 - DNA, 21 bp, Artificial Sequence
  Synthetic construct
aacgcgaacggaggggacgaa

SEQ ID NO: 7264 - DNA, 21 bp, Artificial Sequence
  Synthetic construct
acgcgaacggaggggacgaag

SEQ ID NO: 7265 - DNA, 21 bp, Artificial Sequence
  Synthetic construct
cgcgaacggaggggacgaagg

SEQ ID NO: 7266 - DNA, 21 bp, Artificial Sequence
  Synthetic construct
gcgaacggaggggacgaaggt

SEQ ID NO: 7267 - DNA, 21 bp, Artificial Sequence
  Synthetic construct
cgaacggaggggacgaaggtc

SEQ ID NO: 7268 - DNA, 21 bp, Artificial Sequence
  Synthetic construct
gaacggaggggacgaaggtct

SEQ ID NO: 7269 - DNA, 21 bp, Artificial Sequence
  Synthetic construct
aacggaggggacgaaggtctc

SEQ ID NO: 7270 - DNA, 21 bp, Artificial Sequence
  Synthetic construct
acggaggggacgaaggtctcg

SEQ ID NO: 7271 - DNA, 21 bp, Artificial Sequence
  Synthetic construct
cggaggggacgaaggtctcgt

SEQ ID NO: 7272 - DNA, 21 bp, Artificial Sequence
  Synthetic construct
ggaggggacgaaggtctcgtt

SEQ ID NO: 7273 - DNA, 21 bp, Artificial Sequence
  Synthetic construct
gaggggacgaaggtctcgttc

SEQ ID NO: 7274 - DNA, 21 bp, Artificial Sequence
  Synthetic construct
aggggacgaaggtctcgttct

SEQ ID NO: 7275 - DNA, 21 bp, Artificial Sequence
  Synthetic construct
ggggacgaaggtctcgttctc

SEQ ID NO: 7276 - DNA, 21 bp, Artificial Sequence
  Synthetic construct
gggacgaaggtctcgttctcc

SEQ ID NO: 7277 - DNA, 21 bp, Artificial Sequence
  Synthetic construct
ggacgaaggtctcgttctccc

SEQ ID NO: 7278 - DNA, 21 bp, Artificial Sequence
  Synthetic construct
gacgaaggtctcgttctccct

SEQ ID NO: 7279 - DNA, 21 bp, Artificial Sequence
  Synthetic construct
acgaaggtctcgttctcccta

SEQ ID NO: 7280 - DNA, 21 bp, Artificial Sequence
  Synthetic construct
cgaaggtctcgttctccctat

SEQ ID NO: 7281 - DNA, 21 bp, Artificial Sequence
  Synthetic construct
gaaggtctcgttctccctatc

SEQ ID NO: 7282 - DNA, 21 bp, Artificial Sequence
  Synthetic construct
aaggtctcgttctccctatca

SEQ ID NO: 7283 - DNA, 21 bp, Artificial Sequence
  Synthetic construct
aggtctcgttctccctatcaa

SEQ ID NO: 7284 - DNA, 21 bp, Artificial Sequence
  Synthetic construct
ggtctcgttctccctatcaag

SEQ ID NO: 7285 - DNA, 21 bp, Artificial Sequence
  Synthetic construct
gtctcgttctccctatcaagg

SEQ ID NO: 7286 - DNA, 21 bp, Artificial Sequence
  Synthetic construct
tctcgttctccctatcaaggg

SEQ ID NO: 7287 - DNA, 21 bp, Artificial Sequence
  Synthetic construct
ctcgttctccctatcaagggt

SEQ ID NO: 7288 - DNA, 21 bp, Artificial Sequence
  Synthetic construct
tcgttctccctatcaagggta

SEQ ID NO: 7289 - DNA, 21 bp, Artificial Sequence
  Synthetic construct
cgttctccctatcaagggtac

SEQ ID NO: 7290 - DNA, 21 bp, Artificial Sequence
  Synthetic construct
gttctccctatcaagggtact

SEQ ID NO: 7291 - DNA, 21 bp, Artificial Sequence
  Synthetic construct
ttctccctatcaagggtacta

SEQ ID NO: 7292 - DNA, 21 bp, Artificial Sequence
  Synthetic construct
tctccctatcaagggtactaa

SEQ ID NO: 7293 - DNA, 21 bp, Artificial Sequence
  Synthetic construct
ctccctatcaagggtactaaa

SEQ ID NO: 7294 - DNA, 21 bp, Artificial Sequence
  Synthetic construct
tccctatcaagggtactaaaa

SEQ ID NO: 7295 - DNA, 21 bp, Artificial Sequence
  Synthetic construct
ccctatcaagggtactaaaag

SEQ ID NO: 7296 - DNA, 21 bp, Artificial Sequence
  Synthetic construct
cctatcaagggtactaaaagc

SEQ ID NO: 7297 - DNA, 21 bp, Artificial Sequence
  Synthetic construct
ctatcaagggtactaaaagct

SEQ ID NO: 7298 - DNA, 21 bp, Artificial Sequence
  Synthetic construct
tatcaagggtactaaaagctc

SEQ ID NO: 7299 - DNA, 21 bp, Artificial Sequence
  Synthetic construct
atcaagggtactaaaagctcg

SEQ ID NO: 7300 - DNA, 21 bp, Artificial Sequence
  Synthetic construct
tcaagggtactaaaagctcgc

SEQ ID NO: 7301 - DNA, 21 bp, Artificial Sequence
  Synthetic construct
caagggtactaaaagctcgca

SEQ ID NO: 7302 - DNA, 21 bp, Artificial Sequence
  Synthetic construct
aagggtactaaaagctcgcac

SEQ ID NO: 7303 - DNA, 21 bp, Artificial Sequence
  Synthetic construct
agggtactaaaagctcgcaca

SEQ ID NO: 7304 - DNA, 21 bp, Artificial Sequence
  Synthetic construct
gggtactaaaagctcgcacag

SEQ ID NO: 7305 - DNA, 21 bp, Artificial Sequence
  Synthetic construct
ggtactaaaagctcgcacagg

SEQ ID NO: 7306 - DNA, 21 bp, Artificial Sequence
  Synthetic construct
gtactaaaagctcgcacaggt

SEQ ID NO: 7307 - DNA, 21 bp, Artificial Sequence
  Synthetic construct
tactaaaagctcgcacaggtc

SEQ ID NO: 7308 - DNA, 21 bp, Artificial Sequence
  Synthetic construct
actaaaagctcgcacaggtca

SEQ ID NO: 7309 - DNA, 21 bp, Artificial Sequence
  Synthetic construct
ctaaaagctcgcacaggtcaa

SEQ ID NO: 7310 - DNA, 21 bp, Artificial Sequence
  Synthetic construct
taaaagctcgcacaggtcaaa

SEQ ID NO: 7311 - DNA, 21 bp, Artificial Sequence
  Synthetic construct
aaaagctcgcacaggtcaaac

SEQ ID NO: 7312 - DNA, 21 bp, Artificial Sequence
  Synthetic construct
aaagctcgcacaggtcaaacc

SEQ ID NO: 7313 - DNA, 21 bp, Artificial Sequence
  Synthetic construct
aagctcgcacaggtcaaacct

SEQ ID NO: 7314 - DNA, 21 bp, Artificial Sequence
  Synthetic construct
agctcgcacaggtcaaacctc

SEQ ID NO: 7315 - DNA, 21 bp, Artificial Sequence
  Synthetic construct
gctcgcacaggtcaaacctcc

SEQ ID NO: 7316 - DNA, 21 bp, Artificial Sequence
  Synthetic construct
ctcgcacaggtcaaacctcct

SEQ ID NO: 7317 - DNA, 21 bp, Artificial Sequence
  Synthetic construct
tcgcacaggtcaaacctccta

SEQ ID NO: 7318 - DNA, 21 bp, Artificial Sequence
  Synthetic construct
cgcacaggtcaaacctcctag

SEQ ID NO: 7319 - DNA, 21 bp, Artificial Sequence
  Synthetic construct
gcacaggtcaaacctcctagg

SEQ ID NO: 7320 - DNA, 21 bp, Artificial Sequence
  Synthetic construct
cacaggtcaaacctcctagga

SEQ ID NO: 7321 - DNA, 21 bp, Artificial Sequence
  Synthetic construct
acaggtcaaacctcctaggaa

SEQ ID NO: 7322 - DNA, 21 bp, Artificial Sequence
  Synthetic construct
caggtcaaacctcctaggaat

SEQ ID NO: 7323 - DNA, 21 bp, Artificial Sequence
  Synthetic construct
aggtcaaacctcctaggaatg

SEQ ID NO: 7324 - DNA, 21 bp, Artificial Sequence
  Synthetic construct
ggtcaaacctcctaggaatgg

SEQ ID NO: 7325 - DNA, 21 bp, Artificial Sequence
  Synthetic construct
gtcaaacctcctaggaatgga

SEQ ID NO: 7326 - DNA, 21 bp, Artificial Sequence
  Synthetic construct
tcaaacctcctaggaatggaa

SEQ ID NO: 7327 - DNA, 21 bp, Artificial Sequence
  Synthetic construct
caaacctcctaggaatggaat

SEQ ID NO: 7328 - DNA, 21 bp, Artificial Sequence
  Synthetic construct
aaacctcctaggaatggaatt

SEQ ID NO: 7329 - DNA, 21 bp, Artificial Sequence
  Synthetic construct
aacctcctaggaatggaattc

SEQ ID NO: 7330 - DNA, 21 bp, Artificial Sequence
  Synthetic construct
acctcctaggaatggaattcc

SEQ ID NO: 7331 - DNA, 21 bp, Artificial Sequence
  Synthetic construct
cctcctaggaatggaattccg

SEQ ID NO: 7332 - DNA, 21 bp, Artificial Sequence
  Synthetic construct
ctcctaggaatggaattccgg

SEQ ID NO: 7333 - DNA, 21 bp, Artificial Sequence
  Synthetic construct
tcctaggaatggaattccggc

SEQ ID NO: 7334 - DNA, 21 bp, Artificial Sequence
  Synthetic construct
cctaggaatggaattccggct

SEQ ID NO: 7335 - DNA, 21 bp, Artificial Sequence
  Synthetic construct
ctaggaatggaattccggcta

SEQ ID NO: 7336 - DNA, 21 bp, Artificial Sequence
  Synthetic construct
taggaatggaattccggctac

SEQ ID NO: 7337 - DNA, 21 bp, Artificial Sequence
  Synthetic construct
aggaatggaattccggctacc

SEQ ID NO: 7338 - DNA, 21 bp, Artificial Sequence
  Synthetic construct
ggaatggaattccggctacct

SEQ ID NO: 7339 - DNA, 21 bp, Artificial Sequence
  Synthetic construct
gaatggaattccggctaccta

SEQ ID NO: 7340 - DNA, 21 bp, Artificial Sequence
  Synthetic construct
aatggaattccggctacctac

SEQ ID NO: 7341 - DNA, 21 bp, Artificial Sequence
  Synthetic construct
atggaattccggctacctaca

SEQ ID NO: 7342 - DNA, 21 bp, Artificial Sequence
  Synthetic construct
tggaattccggctacctacag

SEQ ID NO: 7343 - DNA, 21 bp, Artificial Sequence
  Synthetic construct
ggaattccggctacctacagc

SEQ ID NO: 7344 - DNA, 21 bp, Artificial Sequence
  Synthetic construct
gaattccggctacctacagcg

SEQ ID NO: 7345 - DNA, 21 bp, Artificial Sequence
  Synthetic construct
aattccggctacctacagcga

SEQ ID NO: 7346 - DNA, 21 bp, Artificial Sequence
  Synthetic construct
attccggctacctacagcgat

SEQ ID NO: 7347 - DNA, 21 bp, Artificial Sequence
  Synthetic construct
ttccggctacctacagcgata

SEQ ID NO: 7348 - DNA, 21 bp, Artificial Sequence
  Synthetic construct
tccggctacctacagcgatag

SEQ ID NO: 7349 - DNA, 21 bp, Artificial Sequence
  Synthetic construct
ccggctacctacagcgatagc

SEQ ID NO: 7350 - DNA, 21 bp, Artificial Sequence
  Synthetic construct
cggctacctacagcgatagcc

SEQ ID NO: 7351 - DNA, 21 bp, Artificial Sequence
  Synthetic construct
ggctacctacagcgatagcca

SEQ ID NO: 7352 - DNA, 21 bp, Artificial Sequence
  Synthetic construct
gctacctacagcgatagccat

SEQ ID NO: 7353 - DNA, 21 bp, Artificial Sequence
  Synthetic construct
ctacctacagcgatagccatg

SEQ ID NO: 7354 - DNA, 21 bp, Artificial Sequence
  Synthetic construct
tacctacagcgatagccatgg

SEQ ID NO: 7355 - DNA, 21 bp, Artificial Sequence
  Synthetic construct
acctacagcgatagccatggt

SEQ ID NO: 7356 - DNA, 21 bp, Artificial Sequence
  Synthetic construct
cctacagcgatagccatggta

SEQ ID NO: 7357 - DNA, 21 bp, Artificial Sequence
  Synthetic construct
ctacagcgatagccatggtag

SEQ ID NO: 7358 - DNA, 21 bp, Artificial Sequence
  Synthetic construct
tacagcgatagccatggtagc

SEQ ID NO: 7359 - DNA, 21 bp, Artificial Sequence
  Synthetic construct
acagcgatagccatggtagcg

SEQ ID NO: 7360 - DNA, 21 bp, Artificial Sequence
  Synthetic construct
cagcgatagccatggtagcgt

SEQ ID NO: 7361 - DNA, 21 bp, Artificial Sequence
  Synthetic construct
agcgatagccatggtagcgtc

SEQ ID NO: 7362 - DNA, 21 bp, Artificial Sequence
  Synthetic construct
gcgatagccatggtagcgtct

SEQ ID NO: 7363 - DNA, 21 bp, Artificial Sequence
  Synthetic construct
cgatagccatggtagcgtctc

SEQ ID NO: 7364 - DNA, 21 bp, Artificial Sequence
  Synthetic construct
gatagccatggtagcgtctcg

SEQ ID NO: 7365 - DNA, 21 bp, Artificial Sequence
  Synthetic construct
atagccatggtagcgtctcgc

SEQ ID NO: 7366 - DNA, 21 bp, Artificial Sequence
  Synthetic construct
tagccatggtagcgtctcgct

SEQ ID NO: 7367 - DNA, 21 bp, Artificial Sequence
  Synthetic construct
agccatggtagcgtctcgcta

SEQ ID NO: 7368 - DNA, 21 bp, Artificial Sequence
  Synthetic construct
gccatggtagcgtctcgctaa

SEQ ID NO: 7369 - DNA, 21 bp, Artificial Sequence
  Synthetic construct
ccatggtagcgtctcgctaaa

SEQ ID NO: 7370 - DNA, 21 bp, Artificial Sequence
  Synthetic construct
catggtagcgtctcgctaaag

SEQ ID NO: 7371 - DNA, 21 bp, Artificial Sequence
  Synthetic construct
atggtagcgtctcgctaaaga

SEQ ID NO: 7372 - DNA, 21 bp, Artificial Sequence
  Synthetic construct
tggtagcgtctcgctaaagac

SEQ ID NO: 7373 - DNA, 21 bp, Artificial Sequence
  Synthetic construct
ggtagcgtctcgctaaagaca

SEQ ID NO: 7374 - DNA, 21 bp, Artificial Sequence
  Synthetic construct
gtagcgtctcgctaaagacat

SEQ ID NO: 7375 - DNA, 21 bp, Artificial Sequence
  Synthetic construct
tagcgtctcgctaaagacatt

SEQ ID NO: 7376 - DNA, 21 bp, Artificial Sequence
  Synthetic construct
agcgtctcgctaaagacatta

SEQ ID NO: 7377 - DNA, 21 bp, Artificial Sequence
  Synthetic construct
gcgtctcgctaaagacattaa

SEQ ID NO: 7378 - DNA, 21 bp, Artificial Sequence
  Synthetic construct
cgtctcgctaaagacattaaa

SEQ ID NO: 7379 - DNA, 21 bp, Artificial Sequence
  Synthetic construct
gtctcgctaaagacattaaaa

SEQ ID NO: 7380 - DNA, 21 bp, Artificial Sequence
  Synthetic construct
tctcgctaaagacattaaaaa

SEQ ID NO: 7381 - DNA, 21 bp, Artificial Sequence
  Synthetic construct
ctcgctaaagacattaaaaat

SEQ ID NO: 7382 - DNA, 21 bp, Artificial Sequence
  Synthetic construct
tcgctaaagacattaaaaatg

SEQ ID NO: 7383 - DNA, 21 bp, Artificial Sequence
  Synthetic construct
cgctaaagacattaaaaatgg

SEQ ID NO: 7384 - DNA, 21 bp, Artificial Sequence
  Synthetic construct
gctaaagacattaaaaatggc

SEQ ID NO: 7385 - DNA, 21 bp, Artificial Sequence
  Synthetic construct
ctaaagacattaaaaatggca

SEQ ID NO: 7386 - DNA, 21 bp, Artificial Sequence
  Synthetic construct
taaagacattaaaaatggcat

SEQ ID NO: 7387 - DNA, 21 bp, Artificial Sequence
  Synthetic construct
aaagacattaaaaatggcatt

SEQ ID NO: 7388 - DNA, 21 bp, Artificial Sequence
  Synthetic construct
aagacattaaaaatggcatta

SEQ ID NO: 7389 - DNA, 21 bp, Artificial Sequence
  Synthetic construct
agacattaaaaatggcattag

SEQ ID NO: 7390 - DNA, 21 bp, Artificial Sequence
  Synthetic construct
gacattaaaaatggcattagc

SEQ ID NO: 7391 - DNA, 21 bp, Artificial Sequence
  Synthetic construct
acattaaaaatggcattagct

SEQ ID NO: 7392 - DNA, 21 bp, Artificial Sequence
  Synthetic construct
cattaaaaatggcattagctc

SEQ ID NO: 7393 - DNA, 21 bp, Artificial Sequence
  Synthetic construct
attaaaaatggcattagctcg

SEQ ID NO: 7394 - DNA, 21 bp, Artificial Sequence
  Synthetic construct
ttaaaaatggcattagctcga

SEQ ID NO: 7395 - DNA, 21 bp, Artificial Sequence
  Synthetic construct
taaaaatggcattagctcgac

SEQ ID NO: 7396 - DNA, 21 bp, Artificial Sequence
  Synthetic construct
aaaaatggcattagctcgaca

SEQ ID NO: 7397 - DNA, 21 bp, Artificial Sequence
  Synthetic construct
aaaatggcattagctcgacag

SEQ ID NO: 7398 - DNA, 21 bp, Artificial Sequence
  Synthetic construct
aaatggcattagctcgacagg

SEQ ID NO: 7399 - DNA, 21 bp, Artificial Sequence
  Synthetic construct
aatggcattagctcgacagga

SEQ ID NO: 7400 - DNA, 21 bp, Artificial Sequence
  Synthetic construct
atggcattagctcgacaggaa

SEQ ID NO: 7401 - DNA, 21 bp, Artificial Sequence
  Synthetic construct
tggcattagctcgacaggaag

SEQ ID NO: 7402 - DNA, 21 bp, Artificial Sequence
  Synthetic construct
ggcattagctcgacaggaagt

SEQ ID NO: 7403 - DNA, 21 bp, Artificial Sequence
  Synthetic construct
gcattagctcgacaggaagtt

SEQ ID NO: 7404 - DNA, 21 bp, Artificial Sequence
  Synthetic construct
cattagctcgacaggaagttg

SEQ ID NO: 7405 - DNA, 21 bp, Artificial Sequence
  Synthetic construct
attagctcgacaggaagttga

SEQ ID NO: 7406 - DNA, 21 bp, Artificial Sequence
  Synthetic construct
ttagctcgacaggaagttgag

SEQ ID NO: 7407 - DNA, 21 bp, Artificial Sequence
  Synthetic construct
tagctcgacaggaagttgagc

SEQ ID NO: 7408 - DNA, 21 bp, Artificial Sequence
  Synthetic construct
agctcgacaggaagttgagca

SEQ ID NO: 7409 - DNA, 21 bp, Artificial Sequence
  Synthetic construct
gctcgacaggaagttgagcag

SEQ ID NO: 7410 - DNA, 21 bp, Artificial Sequence
  Synthetic construct
ctcgacaggaagttgagcagg

SEQ ID NO: 7411 - DNA, 21 bp, Artificial Sequence
  Synthetic construct
tcgacaggaagttgagcagga

SEQ ID NO: 7412 - DNA, 21 bp, Artificial Sequence
  Synthetic construct
cgacaggaagttgagcaggac

SEQ ID NO: 7413 - DNA, 21 bp, Artificial Sequence
  Synthetic construct
gacaggaagttgagcaggacc

SEQ ID NO: 7414 - DNA, 21 bp, Artificial Sequence
  Synthetic construct
acaggaagttgagcaggaccc

SEQ ID NO: 7415 - DNA, 21 bp, Artificial Sequence
  Synthetic construct
caggaagttgagcaggacccc

SEQ ID NO: 7416 - DNA, 21 bp, Artificial Sequence
  Synthetic construct
aggaagttgagcaggaccccg

SEQ ID NO: 7417 - DNA, 21 bp, Artificial Sequence
  Synthetic construct
ggaagttgagcaggaccccga

SEQ ID NO: 7418 - DNA, 21 bp, Artificial Sequence
  Synthetic construct
gaagttgagcaggaccccgaa

SEQ ID NO: 7419 - DNA, 21 bp, Artificial Sequence
  Synthetic construct
aagttgagcaggaccccgaaa

SEQ ID NO: 7420 - DNA, 21 bp, Artificial Sequence
  Synthetic construct
agttgagcaggaccccgaaag

SEQ ID NO: 7421 - DNA, 21 bp, Artificial Sequence
  Synthetic construct
gttgagcaggaccccgaaagg

SEQ ID NO: 7422 - DNA, 21 bp, Artificial Sequence
  Synthetic construct
ttgagcaggaccccgaaaggg

SEQ ID NO: 7423 - DNA, 21 bp, Artificial Sequence
  Synthetic construct
tgagcaggaccccgaaagggg

SEQ ID NO: 7424 - DNA, 21 bp, Artificial Sequence
  Synthetic construct
gagcaggaccccgaaaggggt

SEQ ID NO: 7425 - DNA, 21 bp, Artificial Sequence
  Synthetic construct
agcaggaccccgaaaggggtc

SEQ ID NO: 7426 - DNA, 21 bp, Artificial Sequence
  Synthetic construct
gcaggaccccgaaaggggtcc

SEQ ID NO: 7427 - DNA, 21 bp, Artificial Sequence
  Synthetic construct
caggaccccgaaaggggtccc

SEQ ID NO: 7428 - DNA, 21 bp, Artificial Sequence
  Synthetic construct
aggaccccgaaaggggtccca

SEQ ID NO: 7429 - DNA, 21 bp, Artificial Sequence
  Synthetic construct
ggaccccgaaaggggtcccac

SEQ ID NO: 7430 - DNA, 21 bp, Artificial Sequence
  Synthetic construct
gaccccgaaaggggtcccacc

SEQ ID NO: 7431 - DNA, 22 bp, Artificial Sequence
  Synthetic construct
tgggtggtaactagccaagcag

SEQ ID NO: 7432 - DNA, 22 bp, Artificial Sequence
  Synthetic construct
gggtggtaactagccaagcagc

SEQ ID NO: 7433 - DNA, 22 bp, Artificial Sequence
  Synthetic construct
ggtggtaactagccaagcagct

SEQ ID NO: 7434 - DNA, 22 bp, Artificial Sequence
  Synthetic construct
gtggtaactagccaagcagcta

SEQ ID NO: 7435 - DNA, 22 bp, Artificial Sequence
  Synthetic construct
tggtaactagccaagcagctag

SEQ ID NO: 7436 - DNA, 22 bp, Artificial Sequence
  Synthetic construct
ggtaactagccaagcagctagt

SEQ ID NO: 7437 - DNA, 22 bp, Artificial Sequence
  Synthetic construct
gtaactagccaagcagctagtt

SEQ ID NO: 7438 - DNA, 22 bp, Artificial Sequence
  Synthetic construct
taactagccaagcagctagtta

SEQ ID NO: 7439 - DNA, 22 bp, Artificial Sequence
  Synthetic construct
aactagccaagcagctagttac

SEQ ID NO: 7440 - DNA, 22 bp, Artificial Sequence
  Synthetic construct
actagccaagcagctagttacc

SEQ ID NO: 7441 - DNA, 22 bp, Artificial Sequence
  Synthetic construct
ctagccaagcagctagttacca

SEQ ID NO: 7442 - DNA, 22 bp, Artificial Sequence
  Synthetic construct
tagccaagcagctagttaccaa

SEQ ID NO: 7443 - DNA, 22 bp, Artificial Sequence
  Synthetic construct
agccaagcagctagttaccaaa

SEQ ID NO: 7444 - DNA, 22 bp, Artificial Sequence
  Synthetic construct
gccaagcagctagttaccaaat

SEQ ID NO: 7445 - DNA, 22 bp, Artificial Sequence
  Synthetic construct
ccaagcagctagttaccaaatc

SEQ ID NO: 7446 - DNA, 22 bp, Artificial Sequence
  Synthetic construct
caagcagctagttaccaaatcg

SEQ ID NO: 7447 - DNA, 22 bp, Artificial Sequence
  Synthetic construct
aagcagctagttaccaaatcgg

SEQ ID NO: 7448 - DNA, 22 bp, Artificial Sequence
  Synthetic construct
agcagctagttaccaaatcggg

SEQ ID NO: 7449 - DNA, 22 bp, Artificial Sequence
  Synthetic construct
gcagctagttaccaaatcggga

SEQ ID NO: 7450 - DNA, 22 bp, Artificial Sequence
  Synthetic construct
cagctagttaccaaatcgggag

SEQ ID NO: 7451 - DNA, 22 bp, Artificial Sequence
  Synthetic construct
agctagttaccaaatcgggaga

SEQ ID NO: 7452 - DNA, 22 bp, Artificial Sequence
  Synthetic construct
gctagttaccaaatcgggagaa

SEQ ID NO: 7453 - DNA, 22 bp, Artificial Sequence
  Synthetic construct
ctagttaccaaatcgggagaat

SEQ ID NO: 7454 - DNA, 22 bp, Artificial Sequence
  Synthetic construct
tagttaccaaatcgggagaatc

SEQ ID NO: 7455 - DNA, 22 bp, Artificial Sequence
  Synthetic construct
agttaccaaatcgggagaatcc

SEQ ID NO: 7456 - DNA, 22 bp, Artificial Sequence
  Synthetic construct
gttaccaaatcgggagaatccc

SEQ ID NO: 7457 - DNA, 22 bp, Artificial Sequence
  Synthetic construct
ttaccaaatcgggagaatcccg

SEQ ID NO: 7458 - DNA, 22 bp, Artificial Sequence
  Synthetic construct
taccaaatcgggagaatcccgg

SEQ ID NO: 7459 - DNA, 22 bp, Artificial Sequence
  Synthetic construct
accaaatcgggagaatcccggg

SEQ ID NO: 7460 - DNA, 22 bp, Artificial Sequence
  Synthetic construct
ccaaatcgggagaatcccgggt

SEQ ID NO: 7461 - DNA, 22 bp, Artificial Sequence
  Synthetic construct
caaatcgggagaatcccgggtc

SEQ ID NO: 7462 - DNA, 22 bp, Artificial Sequence
  Synthetic construct
aaatcgggagaatcccgggtcc

SEQ ID NO: 7463 - DNA, 22 bp, Artificial Sequence
  Synthetic construct
aatcgggagaatcccgggtcct

SEQ ID NO: 7464 - DNA, 22 bp, Artificial Sequence
  Synthetic construct
atcgggagaatcccgggtcctc

SEQ ID NO: 7465 - DNA, 22 bp, Artificial Sequence
  Synthetic construct
tcgggagaatcccgggtcctct

SEQ ID NO: 7466 - DNA, 22 bp, Artificial Sequence
  Synthetic construct
cgggagaatcccgggtcctctc

SEQ ID NO: 7467 - DNA, 22 bp, Artificial Sequence
  Synthetic construct
gggagaatcccgggtcctctct

SEQ ID NO: 7468 - DNA, 22 bp, Artificial Sequence
  Synthetic construct
ggagaatcccgggtcctctctt

SEQ ID NO: 7469 - DNA, 22 bp, Artificial Sequence
  Synthetic construct
gagaatcccgggtcctctcttt

SEQ ID NO: 7470 - DNA, 22 bp, Artificial Sequence
  Synthetic construct
agaatcccgggtcctctcttta

SEQ ID NO: 7471 - DNA, 22 bp, Artificial Sequence
  Synthetic construct
gaatcccgggtcctctctttag

SEQ ID NO: 7472 - DNA, 22 bp, Artificial Sequence
  Synthetic construct
aatcccgggtcctctctttagg

SEQ ID NO: 7473 - DNA, 22 bp, Artificial Sequence
  Synthetic construct
atcccgggtcctctctttaggg

SEQ ID NO: 7474 - DNA, 22 bp, Artificial Sequence
  Synthetic construct
tcccgggtcctctctttagggg

SEQ ID NO: 7475 - DNA, 22 bp, Artificial Sequence
  Synthetic construct
cccgggtcctctctttaggggg

SEQ ID NO: 7476 - DNA, 22 bp, Artificial Sequence
  Synthetic construct
ccgggtcctctctttaggggga

SEQ ID NO: 7477 - DNA, 22 bp, Artificial Sequence
  Synthetic construct
cgggtcctctctttagggggag

SEQ ID NO: 7478 - DNA, 22 bp, Artificial Sequence
  Synthetic construct
gggtcctctctttagggggagg

SEQ ID NO: 7479 - DNA, 22 bp, Artificial Sequence
  Synthetic construct
ggtcctctctttagggggaggt

SEQ ID NO: 7480 - DNA, 22 bp, Artificial Sequence
  Synthetic construct
gtcctctctttagggggaggtc

SEQ ID NO: 7481 - DNA, 22 bp, Artificial Sequence
  Synthetic construct
tcctctctttagggggaggtcc

SEQ ID NO: 7482 - DNA, 22 bp, Artificial Sequence
  Synthetic construct
cctctctttagggggaggtccc

SEQ ID NO: 7483 - DNA, 22 bp, Artificial Sequence
  Synthetic construct
ctctctttagggggaggtccct

SEQ ID NO: 7484 - DNA, 22 bp, Artificial Sequence
  Synthetic construct
tctctttagggggaggtccctg

SEQ ID NO: 7485 - DNA, 22 bp, Artificial Sequence
  Synthetic construct
ctctttagggggaggtccctgg

SEQ ID NO: 7486 - DNA, 22 bp, Artificial Sequence
  Synthetic construct
tctttagggggaggtccctggg

SEQ ID NO: 7487 - DNA, 22 bp, Artificial Sequence
  Synthetic construct
ctttagggggaggtccctgggc

SEQ ID NO: 7488 - DNA, 22 bp, Artificial Sequence
  Synthetic construct
tttagggggaggtccctgggcc

SEQ ID NO: 7489 - DNA, 22 bp, Artificial Sequence
  Synthetic construct
ttagggggaggtccctgggccg

SEQ ID NO: 7490 - DNA, 22 bp, Artificial Sequence
  Synthetic construct
tagggggaggtccctgggccga

SEQ ID NO: 7491 - DNA, 22 bp, Artificial Sequence
  Synthetic construct
agggggaggtccctgggccgaa

SEQ ID NO: 7492 - DNA, 22 bp, Artificial Sequence
  Synthetic construct
gggggaggtccctgggccgaag

SEQ ID NO: 7493 - DNA, 22 bp, Artificial Sequence
  Synthetic construct
ggggaggtccctgggccgaagc

SEQ ID NO: 7494 - DNA, 22 bp, Artificial Sequence
  Synthetic construct
gggaggtccctgggccgaagcc

SEQ ID NO: 7495 - DNA, 22 bp, Artificial Sequence
  Synthetic construct
ggaggtccctgggccgaagccc

SEQ ID NO: 7496 - DNA, 22 bp, Artificial Sequence
  Synthetic construct
gaggtccctgggccgaagcccg

SEQ ID NO: 7497 - DNA, 22 bp, Artificial Sequence
  Synthetic construct
aggtccctgggccgaagcccgc

SEQ ID NO: 7498 - DNA, 22 bp, Artificial Sequence
  Synthetic construct
ggtccctgggccgaagcccgcc

SEQ ID NO: 7499 - DNA, 22 bp, Artificial Sequence
  Synthetic construct
gtccctgggccgaagcccgccc

SEQ ID NO: 7500 - DNA, 22 bp, Artificial Sequence
  Synthetic construct
tccctgggccgaagcccgccca

SEQ ID NO: 7501 - DNA, 22 bp, Artificial Sequence
  Synthetic construct
ccctgggccgaagcccgcccac

SEQ ID NO: 7502 - DNA, 22 bp, Artificial Sequence
  Synthetic construct
cctgggccgaagcccgcccacc

SEQ ID NO: 7503 - DNA, 22 bp, Artificial Sequence
  Synthetic construct
ctgggccgaagcccgcccacct

SEQ ID NO: 7504 - DNA, 22 bp, Artificial Sequence
  Synthetic construct
tgggccgaagcccgcccacctt

SEQ ID NO: 7505 - DNA, 22 bp, Artificial Sequence
  Synthetic construct
gggccgaagcccgcccaccttt

SEQ ID NO: 7506 - DNA, 22 bp, Artificial Sequence
  Synthetic construct
ggccgaagcccgcccacctttc

SEQ ID NO: 7507 - DNA, 22 bp, Artificial Sequence
  Synthetic construct
gccgaagcccgcccacctttcg

SEQ ID NO: 7508 - DNA, 22 bp, Artificial Sequence
  Synthetic construct
ccgaagcccgcccacctttcgg

SEQ ID NO: 7509 - DNA, 22 bp, Artificial Sequence
  Synthetic construct
cgaagcccgcccacctttcggt

SEQ ID NO: 7510 - DNA, 22 bp, Artificial Sequence
  Synthetic construct
gaagcccgcccacctttcggtg

SEQ ID NO: 7511 - DNA, 22 bp, Artificial Sequence
  Synthetic construct
aagcccgcccacctttcggtgg

SEQ ID NO: 7512 - DNA, 22 bp, Artificial Sequence
  Synthetic construct
agcccgcccacctttcggtgga

SEQ ID NO: 7513 - DNA, 22 bp, Artificial Sequence
  Synthetic construct
gcccgcccacctttcggtggag

SEQ ID NO: 7514 - DNA, 22 bp, Artificial Sequence
  Synthetic construct
cccgcccacctttcggtggagc

SEQ ID NO: 7515 - DNA, 22 bp, Artificial Sequence
  Synthetic construct
ccgcccacctttcggtggagcc

SEQ ID NO: 7516 - DNA, 22 bp, Artificial Sequence
  Synthetic construct
cgcccacctttcggtggagccg

SEQ ID NO: 7517 - DNA, 22 bp, Artificial Sequence
  Synthetic construct
gcccacctttcggtggagccgg

SEQ ID NO: 7518 - DNA, 22 bp, Artificial Sequence
  Synthetic construct
cccacctttcggtggagccgga

SEQ ID NO: 7519 - DNA, 22 bp, Artificial Sequence
  Synthetic construct
ccacctttcggtggagccggac

SEQ ID NO: 7520 - DNA, 22 bp, Artificial Sequence
  Synthetic construct
cacctttcggtggagccggacc

SEQ ID NO: 7521 - DNA, 22 bp, Artificial Sequence
  Synthetic construct
acctttcggtggagccggaccg

SEQ ID NO: 7522 - DNA, 22 bp, Artificial Sequence
  Synthetic construct
cctttcggtggagccggaccgc

SEQ ID NO: 7523 - DNA, 22 bp, Artificial Sequence
  Synthetic construct
ctttcggtggagccggaccgct

SEQ ID NO: 7524 - DNA, 22 bp, Artificial Sequence
  Synthetic construct
tttcggtggagccggaccgctt

SEQ ID NO: 7525 - DNA, 22 bp, Artificial Sequence
  Synthetic construct
ttcggtggagccggaccgcttt

SEQ ID NO: 7526 - DNA, 22 bp, Artificial Sequence
  Synthetic construct
tcggtggagccggaccgctttc

SEQ ID NO: 7527 - DNA, 22 bp, Artificial Sequence
  Synthetic construct
cggtggagccggaccgctttcg

SEQ ID NO: 7528 - DNA, 22 bp, Artificial Sequence
  Synthetic construct
ggtggagccggaccgctttcgc

SEQ ID NO: 7529 - DNA, 22 bp, Artificial Sequence
  Synthetic construct
gtggagccggaccgctttcgca

SEQ ID NO: 7530 - DNA, 22 bp, Artificial Sequence
  Synthetic construct
tggagccggaccgctttcgcac

SEQ ID NO: 7531 - DNA, 22 bp, Artificial Sequence
  Synthetic construct
ggagccggaccgctttcgcacc

SEQ ID NO: 7532 - DNA, 22 bp, Artificial Sequence
  Synthetic construct
gagccggaccgctttcgcaccc

SEQ ID NO: 7533 - DNA, 22 bp, Artificial Sequence
  Synthetic construct
agccggaccgctttcgcacccg

SEQ ID NO: 7534 - DNA, 22 bp, Artificial Sequence
  Synthetic construct
gccggaccgctttcgcacccgt

SEQ ID NO: 7535 - DNA, 22 bp, Artificial Sequence
  Synthetic construct
ccggaccgctttcgcacccgtg

SEQ ID NO: 7536 - DNA, 22 bp, Artificial Sequence
  Synthetic construct
cggaccgctttcgcacccgtgc

SEQ ID NO: 7537 - DNA, 22 bp, Artificial Sequence
  Synthetic construct
ggaccgctttcgcacccgtgct

SEQ ID NO: 7538 - DNA, 22 bp, Artificial Sequence
  Synthetic construct
gaccgctttcgcacccgtgctc

SEQ ID NO: 7539 - DNA, 22 bp, Artificial Sequence
  Synthetic construct
accgctttcgcacccgtgctct

SEQ ID NO: 7540 - DNA, 22 bp, Artificial Sequence
  Synthetic construct
ccgctttcgcacccgtgctctt

SEQ ID NO: 7541 - DNA, 22 bp, Artificial Sequence
  Synthetic construct
cgctttcgcacccgtgctcttt

SEQ ID NO: 7542 - DNA, 22 bp, Artificial Sequence
  Synthetic construct
gctttcgcacccgtgctctttc

SEQ ID NO: 7543 - DNA, 22 bp, Artificial Sequence
  Synthetic construct
ctttcgcacccgtgctctttcg

SEQ ID NO: 7544 - DNA, 22 bp, Artificial Sequence
  Synthetic construct
tttcgcacccgtgctctttcga

SEQ ID NO: 7545 - DNA, 22 bp, Artificial Sequence
  Synthetic construct
ttcgcacccgtgctctttcgag

SEQ ID NO: 7546 - DNA, 22 bp, Artificial Sequence
  Synthetic construct
tcgcacccgtgctctttcgagc

SEQ ID NO: 7547 - DNA, 22 bp, Artificial Sequence
  Synthetic construct
cgcacccgtgctctttcgagca

SEQ ID NO: 7548 - DNA, 22 bp, Artificial Sequence
  Synthetic construct
gcacccgtgctctttcgagcac

SEQ ID NO: 7549 - DNA, 22 bp, Artificial Sequence
  Synthetic construct
cacccgtgctctttcgagcaca

SEQ ID NO: 7550 - DNA, 22 bp, Artificial Sequence
  Synthetic construct
acccgtgctctttcgagcacac

SEQ ID NO: 7551 - DNA, 22 bp, Artificial Sequence
  Synthetic construct
cccgtgctctttcgagcacacc

SEQ ID NO: 7552 - DNA, 22 bp, Artificial Sequence
  Synthetic construct
ccgtgctctttcgagcacaccc

SEQ ID NO: 7553 - DNA, 22 bp, Artificial Sequence
  Synthetic construct
cgtgctctttcgagcacaccca

SEQ ID NO: 7554 - DNA, 22 bp, Artificial Sequence
  Synthetic construct
gtgctctttcgagcacacccac

SEQ ID NO: 7555 - DNA, 22 bp, Artificial Sequence
  Synthetic construct
tgctctttcgagcacacccacc

SEQ ID NO: 7556 - DNA, 22 bp, Artificial Sequence
  Synthetic construct
gctctttcgagcacacccaccc

SEQ ID NO: 7557 - DNA, 22 bp, Artificial Sequence
  Synthetic construct
ctctttcgagcacacccacccc

SEQ ID NO: 7558 - DNA, 22 bp, Artificial Sequence
  Synthetic construct
tctttcgagcacacccaccccg

SEQ ID NO: 7559 - DNA, 22 bp, Artificial Sequence
  Synthetic construct
ctttcgagcacacccaccccgt

SEQ ID NO: 7560 - DNA, 22 bp, Artificial Sequence
  Synthetic construct
tttcgagcacacccaccccgtt

SEQ ID NO: 7561 - DNA, 22 bp, Artificial Sequence
  Synthetic construct
ttcgagcacacccaccccgttt

SEQ ID NO: 7562 - DNA, 22 bp, Artificial Sequence
  Synthetic construct
tcgagcacacccaccccgttta

SEQ ID NO: 7563 - DNA, 22 bp, Artificial Sequence
  Synthetic construct
cgagcacacccaccccgtttac

SEQ ID NO: 7564 - DNA, 22 bp, Artificial Sequence
  Synthetic construct
gagcacacccaccccgtttacg

SEQ ID NO: 7565 - DNA, 22 bp, Artificial Sequence
  Synthetic construct
agcacacccaccccgtttacgg

SEQ ID NO: 7566 - DNA, 22 bp, Artificial Sequence
  Synthetic construct
gcacacccaccccgtttacggg

SEQ ID NO: 7567 - DNA, 22 bp, Artificial Sequence
  Synthetic construct
cacacccaccccgtttacgggg

SEQ ID NO: 7568 - DNA, 22 bp, Artificial Sequence
  Synthetic construct
acacccaccccgtttacggggg

SEQ ID NO: 7569 - DNA, 22 bp, Artificial Sequence
  Synthetic construct
cacccaccccgtttacgggggt

SEQ ID NO: 7570 - DNA, 22 bp, Artificial Sequence
  Synthetic construct
acccaccccgtttacgggggtc

SEQ ID NO: 7571 - DNA, 22 bp, Artificial Sequence
  Synthetic construct
cccaccccgtttacgggggtcc

SEQ ID NO: 7572 - DNA, 22 bp, Artificial Sequence
  Synthetic construct
ccaccccgtttacgggggtccc

SEQ ID NO: 7573 - DNA, 22 bp, Artificial Sequence
  Synthetic construct
caccccgtttacgggggtccct

SEQ ID NO: 7574 - DNA, 22 bp, Artificial Sequence
  Synthetic construct
accccgtttacgggggtccctc

SEQ ID NO: 7575 - DNA, 22 bp, Artificial Sequence
  Synthetic construct
ccccgtttacgggggtccctcg

SEQ ID NO: 7576 - DNA, 22 bp, Artificial Sequence
  Synthetic construct
cccgtttacgggggtccctcgg

SEQ ID NO: 7577 - DNA, 22 bp, Artificial Sequence
  Synthetic construct
ccgtttacgggggtccctcggt

SEQ ID NO: 7578 - DNA, 22 bp, Artificial Sequence
  Synthetic construct
cgtttacgggggtccctcggtc

SEQ ID NO: 7579 - DNA, 22 bp, Artificial Sequence
  Synthetic construct
gtttacgggggtccctcggtca

SEQ ID NO: 7580 - DNA, 22 bp, Artificial Sequence
  Synthetic construct
tttacgggggtccctcggtcag

SEQ ID NO: 7581 - DNA, 22 bp, Artificial Sequence
  Synthetic construct
ttacgggggtccctcggtcagc

SEQ ID NO: 7582 - DNA, 22 bp, Artificial Sequence
  Synthetic construct
tacgggggtccctcggtcagct

SEQ ID NO: 7583 - DNA, 22 bp, Artificial Sequence
  Synthetic construct
acgggggtccctcggtcagcta

SEQ ID NO: 7584 - DNA, 22 bp, Artificial Sequence
  Synthetic construct
cgggggtccctcggtcagctac

SEQ ID NO: 7585 - DNA, 22 bp, Artificial Sequence
  Synthetic construct
gggggtccctcggtcagctacc

SEQ ID NO: 7586 - DNA, 22 bp, Artificial Sequence
  Synthetic construct
ggggtccctcggtcagctaccg

SEQ ID NO: 7587 - DNA, 22 bp, Artificial Sequence
  Synthetic construct
gggtccctcggtcagctaccga

SEQ ID NO: 7588 - DNA, 22 bp, Artificial Sequence
  Synthetic construct
ggtccctcggtcagctaccgag

SEQ ID NO: 7589 - DNA, 22 bp, Artificial Sequence
  Synthetic construct
gtccctcggtcagctaccgagg

SEQ ID NO: 7590 - DNA, 22 bp, Artificial Sequence
  Synthetic construct
tccctcggtcagctaccgagga

SEQ ID NO: 7591 - DNA, 22 bp, Artificial Sequence
  Synthetic construct
ccctcggtcagctaccgaggag

SEQ ID NO: 7592 - DNA, 22 bp, Artificial Sequence
  Synthetic construct
cctcggtcagctaccgaggaga

SEQ ID NO: 7593 - DNA, 22 bp, Artificial Sequence
  Synthetic construct
ctcggtcagctaccgaggagag

SEQ ID NO: 7594 - DNA, 22 bp, Artificial Sequence
  Synthetic construct
tcggtcagctaccgaggagagc

SEQ ID NO: 7595 - DNA, 22 bp, Artificial Sequence
  Synthetic construct
cggtcagctaccgaggagagct

SEQ ID NO: 7596 - DNA, 22 bp, Artificial Sequence
  Synthetic construct
ggtcagctaccgaggagagctc

SEQ ID NO: 7597 - DNA, 22 bp, Artificial Sequence
  Synthetic construct
gtcagctaccgaggagagctcg

SEQ ID NO: 7598 - DNA, 22 bp, Artificial Sequence
  Synthetic construct
tcagctaccgaggagagctcgc

SEQ ID NO: 7599 - DNA, 22 bp, Artificial Sequence
  Synthetic construct
cagctaccgaggagagctcgct

SEQ ID NO: 7600 - DNA, 22 bp, Artificial Sequence
  Synthetic construct
agctaccgaggagagctcgctg

SEQ ID NO: 7601 - DNA, 22 bp, Artificial Sequence
  Synthetic construct
gctaccgaggagagctcgctgg

SEQ ID NO: 7602 - DNA, 22 bp, Artificial Sequence
  Synthetic construct
ctaccgaggagagctcgctggc

SEQ ID NO: 7603 - DNA, 22 bp, Artificial Sequence
  Synthetic construct
taccgaggagagctcgctggcc

SEQ ID NO: 7604 - DNA, 22 bp, Artificial Sequence
  Synthetic construct
accgaggagagctcgctggccc

SEQ ID NO: 7605 - DNA, 22 bp, Artificial Sequence
  Synthetic construct
ccgaggagagctcgctggccca

SEQ ID NO: 7606 - DNA, 22 bp, Artificial Sequence
  Synthetic construct
cgaggagagctcgctggcccac

SEQ ID NO: 7607 - DNA, 22 bp, Artificial Sequence
  Synthetic construct
gaggagagctcgctggcccaca

SEQ ID NO: 7608 - DNA, 22 bp, Artificial Sequence
  Synthetic construct
aggagagctcgctggcccacac

SEQ ID NO: 7609 - DNA, 22 bp, Artificial Sequence
  Synthetic construct
ggagagctcgctggcccacact

SEQ ID NO: 7610 - DNA, 22 bp, Artificial Sequence
  Synthetic construct
gagagctcgctggcccacactc

SEQ ID NO: 7611 - DNA, 22 bp, Artificial Sequence
  Synthetic construct
agagctcgctggcccacactcc

SEQ ID NO: 7612 - DNA, 22 bp, Artificial Sequence
  Synthetic construct
gagctcgctggcccacactcct

SEQ ID NO: 7613 - DNA, 22 bp, Artificial Sequence
  Synthetic construct
agctcgctggcccacactcctg

SEQ ID NO: 7614 - DNA, 22 bp, Artificial Sequence
  Synthetic construct
gctcgctggcccacactcctga

SEQ ID NO: 7615 - DNA, 22 bp, Artificial Sequence
  Synthetic construct
ctcgctggcccacactcctgag

SEQ ID NO: 7616 - DNA, 22 bp, Artificial Sequence
  Synthetic construct
tcgctggcccacactcctgagg

SEQ ID NO: 7617 - DNA, 22 bp, Artificial Sequence
  Synthetic construct
cgctggcccacactcctgaggg

SEQ ID NO: 7618 - DNA, 22 bp, Artificial Sequence
  Synthetic construct
gctggcccacactcctgaggga

SEQ ID NO: 7619 - DNA, 22 bp, Artificial Sequence
  Synthetic construct
ctggcccacactcctgagggaa

SEQ ID NO: 7620 - DNA, 22 bp, Artificial Sequence
  Synthetic construct
tggcccacactcctgagggaat

SEQ ID NO: 7621 - DNA, 22 bp, Artificial Sequence
  Synthetic construct
ggcccacactcctgagggaatg

SEQ ID NO: 7622 - DNA, 22 bp, Artificial Sequence
  Synthetic construct
gcccacactcctgagggaatgt

SEQ ID NO: 7623 - DNA, 22 bp, Artificial Sequence
  Synthetic construct
cccacactcctgagggaatgtg

SEQ ID NO: 7624 - DNA, 22 bp, Artificial Sequence
  Synthetic construct
ccacactcctgagggaatgtgg

SEQ ID NO: 7625 - DNA, 22 bp, Artificial Sequence
  Synthetic construct
cacactcctgagggaatgtggg

SEQ ID NO: 7626 - DNA, 22 bp, Artificial Sequence
  Synthetic construct
acactcctgagggaatgtggga

SEQ ID NO: 7627 - DNA, 22 bp, Artificial Sequence
  Synthetic construct
cactcctgagggaatgtgggaa

SEQ ID NO: 7628 - DNA, 22 bp, Artificial Sequence
  Synthetic construct
actcctgagggaatgtgggaac

SEQ ID NO: 7629 - DNA, 22 bp, Artificial Sequence
  Synthetic construct
ctcctgagggaatgtgggaacc

SEQ ID NO: 7630 - DNA, 22 bp, Artificial Sequence
  Synthetic construct
tcctgagggaatgtgggaaccg

SEQ ID NO: 7631 - DNA, 22 bp, Artificial Sequence
  Synthetic construct
cctgagggaatgtgggaaccgg

SEQ ID NO: 7632 - DNA, 22 bp, Artificial Sequence
  Synthetic construct
ctgagggaatgtgggaaccggc

SEQ ID NO: 7633 - DNA, 22 bp, Artificial Sequence
  Synthetic construct
tgagggaatgtgggaaccggcg

SEQ ID NO: 7634 - DNA, 22 bp, Artificial Sequence
  Synthetic construct
gagggaatgtgggaaccggcgt

SEQ ID NO: 7635 - DNA, 22 bp, Artificial Sequence
  Synthetic construct
agggaatgtgggaaccggcgtt

SEQ ID NO: 7636 - DNA, 22 bp, Artificial Sequence
  Synthetic construct
gggaatgtgggaaccggcgtta

SEQ ID NO: 7637 - DNA, 22 bp, Artificial Sequence
  Synthetic construct
ggaatgtgggaaccggcgttag

SEQ ID NO: 7638 - DNA, 22 bp, Artificial Sequence
  Synthetic construct
gaatgtgggaaccggcgttagc

SEQ ID NO: 7639 - DNA, 22 bp, Artificial Sequence
  Synthetic construct
aatgtgggaaccggcgttagcc

SEQ ID NO: 7640 - DNA, 22 bp, Artificial Sequence
  Synthetic construct
atgtgggaaccggcgttagcca

SEQ ID NO: 7641 - DNA, 22 bp, Artificial Sequence
  Synthetic construct
tgtgggaaccggcgttagccac

SEQ ID NO: 7642 - DNA, 22 bp, Artificial Sequence
  Synthetic construct
gtgggaaccggcgttagccact

SEQ ID NO: 7643 - DNA, 22 bp, Artificial Sequence
  Synthetic construct
tgggaaccggcgttagccactc

SEQ ID NO: 7644 - DNA, 22 bp, Artificial Sequence
  Synthetic construct
gggaaccggcgttagccactcc

SEQ ID NO: 7645 - DNA, 22 bp, Artificial Sequence
  Synthetic construct
ggaaccggcgttagccactccg

SEQ ID NO: 7646 - DNA, 22 bp, Artificial Sequence
  Synthetic construct
gaaccggcgttagccactccga

SEQ ID NO: 7647 - DNA, 22 bp, Artificial Sequence
  Synthetic construct
aaccggcgttagccactccgaa

SEQ ID NO: 7648 - DNA, 22 bp, Artificial Sequence
  Synthetic construct
accggcgttagccactccgaag

SEQ ID NO: 7649 - DNA, 22 bp, Artificial Sequence
  Synthetic construct
ccggcgttagccactccgaagt

SEQ ID NO: 7650 - DNA, 22 bp, Artificial Sequence
  Synthetic construct
cggcgttagccactccgaagtg

SEQ ID NO: 7651 - DNA, 22 bp, Artificial Sequence
  Synthetic construct
ggcgttagccactccgaagtgc

SEQ ID NO: 7652 - DNA, 22 bp, Artificial Sequence
  Synthetic construct
gcgttagccactccgaagtgcg

SEQ ID NO: 7653 - DNA, 22 bp, Artificial Sequence
  Synthetic construct
cgttagccactccgaagtgcgt

SEQ ID NO: 7654 - DNA, 22 bp, Artificial Sequence
  Synthetic construct
gttagccactccgaagtgcgta

SEQ ID NO: 7655 - DNA, 22 bp, Artificial Sequence
  Synthetic construct
ttagccactccgaagtgcgtat

SEQ ID NO: 7656 - DNA, 22 bp, Artificial Sequence
  Synthetic construct
tagccactccgaagtgcgtata

SEQ ID NO: 7657 - DNA, 22 bp, Artificial Sequence
  Synthetic construct
agccactccgaagtgcgtataa

SEQ ID NO: 7658 - DNA, 22 bp, Artificial Sequence
  Synthetic construct
gccactccgaagtgcgtataac

SEQ ID NO: 7659 - DNA, 22 bp, Artificial Sequence
  Synthetic construct
ccactccgaagtgcgtataacg

SEQ ID NO: 7660 - DNA, 22 bp, Artificial Sequence
  Synthetic construct
cactccgaagtgcgtataacgc

SEQ ID NO: 7661 - DNA, 22 bp, Artificial Sequence
  Synthetic construct
actccgaagtgcgtataacgcg

SEQ ID NO: 7662 - DNA, 22 bp, Artificial Sequence
  Synthetic construct
ctccgaagtgcgtataacgcgc

SEQ ID NO: 7663 - DNA, 22 bp, Artificial Sequence
  Synthetic construct
tccgaagtgcgtataacgcgca

SEQ ID NO: 7664 - DNA, 22 bp, Artificial Sequence
  Synthetic construct
ccgaagtgcgtataacgcgcac

SEQ ID NO: 7665 - DNA, 22 bp, Artificial Sequence
  Synthetic construct
cgaagtgcgtataacgcgcacg

SEQ ID NO: 7666 - DNA, 22 bp, Artificial Sequence
  Synthetic construct
gaagtgcgtataacgcgcacgc

SEQ ID NO: 7667 - DNA, 22 bp, Artificial Sequence
  Synthetic construct
aagtgcgtataacgcgcacgcc

SEQ ID NO: 7668 - DNA, 22 bp, Artificial Sequence
  Synthetic construct
agtgcgtataacgcgcacgccg

SEQ ID NO: 7669 - DNA, 22 bp, Artificial Sequence
  Synthetic construct
gtgcgtataacgcgcacgccgg

SEQ ID NO: 7670 - DNA, 22 bp, Artificial Sequence
  Synthetic construct
tgcgtataacgcgcacgccggc

SEQ ID NO: 7671 - DNA, 22 bp, Artificial Sequence
  Synthetic construct
gcgtataacgcgcacgccggcg

SEQ ID NO: 7672 - DNA, 22 bp, Artificial Sequence
  Synthetic construct
cgtataacgcgcacgccggcgg

SEQ ID NO: 7673 - DNA, 22 bp, Artificial Sequence
  Synthetic construct
gtataacgcgcacgccggcgga

SEQ ID NO: 7674 - DNA, 22 bp, Artificial Sequence
  Synthetic construct
tataacgcgcacgccggcggac

SEQ ID NO: 7675 - DNA, 22 bp, Artificial Sequence
  Synthetic construct
ataacgcgcacgccggcggact

SEQ ID NO: 7676 - DNA, 22 bp, Artificial Sequence
  Synthetic construct
taacgcgcacgccggcggactt

SEQ ID NO: 7677 - DNA, 22 bp, Artificial Sequence
  Synthetic construct
aacgcgcacgccggcggacttc

SEQ ID NO: 7678 - DNA, 22 bp, Artificial Sequence
  Synthetic construct
acgcgcacgccggcggacttca

SEQ ID NO: 7679 - DNA, 22 bp, Artificial Sequence
  Synthetic construct
cgcgcacgccggcggacttcat

SEQ ID NO: 7680 - DNA, 22 bp, Artificial Sequence
  Synthetic construct
gcgcacgccggcggacttcatg

SEQ ID NO: 7681 - DNA, 22 bp, Artificial Sequence
  Synthetic construct
cgcacgccggcggacttcatgc

SEQ ID NO: 7682 - DNA, 22 bp, Artificial Sequence
  Synthetic construct
gcacgccggcggacttcatgct

SEQ ID NO: 7683 - DNA, 22 bp, Artificial Sequence
  Synthetic construct
cacgccggcggacttcatgctg

SEQ ID NO: 7684 - DNA, 22 bp, Artificial Sequence
  Synthetic construct
acgccggcggacttcatgctgt

SEQ ID NO: 7685 - DNA, 22 bp, Artificial Sequence
  Synthetic construct
cgccggcggacttcatgctgtc

SEQ ID NO: 7686 - DNA, 22 bp, Artificial Sequence
  Synthetic construct
gccggcggacttcatgctgtcg

SEQ ID NO: 7687 - DNA, 22 bp, Artificial Sequence
  Synthetic construct
ccggcggacttcatgctgtcgg

SEQ ID NO: 7688 - DNA, 22 bp, Artificial Sequence
  Synthetic construct
cggcggacttcatgctgtcggt

SEQ ID NO: 7689 - DNA, 22 bp, Artificial Sequence
  Synthetic construct
ggcggacttcatgctgtcggtg

SEQ ID NO: 7690 - DNA, 22 bp, Artificial Sequence
  Synthetic construct
gcggacttcatgctgtcggtga

SEQ ID NO: 7691 - DNA, 22 bp, Artificial Sequence
  Synthetic construct
cggacttcatgctgtcggtgat

SEQ ID NO: 7692 - DNA, 22 bp, Artificial Sequence
  Synthetic construct
ggacttcatgctgtcggtgatt

SEQ ID NO: 7693 - DNA, 22 bp, Artificial Sequence
  Synthetic construct
gacttcatgctgtcggtgattt

SEQ ID NO: 7694 - DNA, 22 bp, Artificial Sequence
  Synthetic construct
acttcatgctgtcggtgatttc

SEQ ID NO: 7695 - DNA, 22 bp, Artificial Sequence
  Synthetic construct
cttcatgctgtcggtgatttca

SEQ ID NO: 7696 - DNA, 22 bp, Artificial Sequence
  Synthetic construct
ttcatgctgtcggtgatttcac

SEQ ID NO: 7697 - DNA, 22 bp, Artificial Sequence
  Synthetic construct
tcatgctgtcggtgatttcacc

SEQ ID NO: 7698 - DNA, 22 bp, Artificial Sequence
  Synthetic construct
catgctgtcggtgatttcacct

SEQ ID NO: 7699 - DNA, 22 bp, Artificial Sequence
  Synthetic construct
atgctgtcggtgatttcacctc

SEQ ID NO: 7700 - DNA, 22 bp, Artificial Sequence
  Synthetic construct
tgctgtcggtgatttcacctcc

SEQ ID NO: 7701 - DNA, 22 bp, Artificial Sequence
  Synthetic construct
gctgtcggtgatttcacctcca

SEQ ID NO: 7702 - DNA, 22 bp, Artificial Sequence
  Synthetic construct
ctgtcggtgatttcacctccag

SEQ ID NO: 7703 - DNA, 22 bp, Artificial Sequence
  Synthetic construct
tgtcggtgatttcacctccagt

SEQ ID NO: 7704 - DNA, 22 bp, Artificial Sequence
  Synthetic construct
gtcggtgatttcacctccagta

SEQ ID NO: 7705 - DNA, 22 bp, Artificial Sequence
  Synthetic construct
tcggtgatttcacctccagtat

SEQ ID NO: 7706 - DNA, 22 bp, Artificial Sequence
  Synthetic construct
cggtgatttcacctccagtatg

SEQ ID NO: 7707 - DNA, 22 bp, Artificial Sequence
  Synthetic construct
ggtgatttcacctccagtatgg

SEQ ID NO: 7708 - DNA, 22 bp, Artificial Sequence
  Synthetic construct
gtgatttcacctccagtatgga

SEQ ID NO: 7709 - DNA, 22 bp, Artificial Sequence
  Synthetic construct
tgatttcacctccagtatggaa

SEQ ID NO: 7710 - DNA, 22 bp, Artificial Sequence
  Synthetic construct
gatttcacctccagtatggaac

SEQ ID NO: 7711 - DNA, 22 bp, Artificial Sequence
  Synthetic construct
atttcacctccagtatggaacc

SEQ ID NO: 7712 - DNA, 22 bp, Artificial Sequence
  Synthetic construct
tttcacctccagtatggaacca

SEQ ID NO: 7713 - DNA, 22 bp, Artificial Sequence
  Synthetic construct
ttcacctccagtatggaaccac

SEQ ID NO: 7714 - DNA, 22 bp, Artificial Sequence
  Synthetic construct
tcacctccagtatggaaccacg

SEQ ID NO: 7715 - DNA, 22 bp, Artificial Sequence
  Synthetic construct
cacctccagtatggaaccacgc

SEQ ID NO: 7716 - DNA, 22 bp, Artificial Sequence
  Synthetic construct
acctccagtatggaaccacgct

SEQ ID NO: 7717 - DNA, 22 bp, Artificial Sequence
  Synthetic construct
cctccagtatggaaccacgcta

SEQ ID NO: 7718 - DNA, 22 bp, Artificial Sequence
  Synthetic construct
ctccagtatggaaccacgctat

SEQ ID NO: 7719 - DNA, 22 bp, Artificial Sequence
  Synthetic construct
tccagtatggaaccacgctatg

SEQ ID NO: 7720 - DNA, 22 bp, Artificial Sequence
  Synthetic construct
ccagtatggaaccacgctatgt

SEQ ID NO: 7721 - DNA, 22 bp, Artificial Sequence
  Synthetic construct
cagtatggaaccacgctatgta

SEQ ID NO: 7722 - DNA, 22 bp, Artificial Sequence
  Synthetic construct
agtatggaaccacgctatgtag

SEQ ID NO: 7723 - DNA, 22 bp, Artificial Sequence
  Synthetic construct
gtatggaaccacgctatgtagc

SEQ ID NO: 7724 - DNA, 22 bp, Artificial Sequence
  Synthetic construct
tatggaaccacgctatgtagcg

SEQ ID NO: 7725 - DNA, 22 bp, Artificial Sequence
  Synthetic construct
atggaaccacgctatgtagcga

SEQ ID NO: 7726 - DNA, 22 bp, Artificial Sequence
  Synthetic construct
tggaaccacgctatgtagcgac

SEQ ID NO: 7727 - DNA, 22 bp, Artificial Sequence
  Synthetic construct
ggaaccacgctatgtagcgacc

SEQ ID NO: 7728 - DNA, 22 bp, Artificial Sequence
  Synthetic construct
gaaccacgctatgtagcgacca

SEQ ID NO: 7729 - DNA, 22 bp, Artificial Sequence
  Synthetic construct
aaccacgctatgtagcgaccac

SEQ ID NO: 7730 - DNA, 22 bp, Artificial Sequence
  Synthetic construct
accacgctatgtagcgaccact

SEQ ID NO: 7731 - DNA, 22 bp, Artificial Sequence
  Synthetic construct
ccacgctatgtagcgaccactg

SEQ ID NO: 7732 - DNA, 22 bp, Artificial Sequence
  Synthetic construct
cacgctatgtagcgaccactgt

SEQ ID NO: 7733 - DNA, 22 bp, Artificial Sequence
  Synthetic construct
acgctatgtagcgaccactgtc

SEQ ID NO: 7734 - DNA, 22 bp, Artificial Sequence
  Synthetic construct
cgctatgtagcgaccactgtcg

SEQ ID NO: 7735 - DNA, 22 bp, Artificial Sequence
  Synthetic construct
gctatgtagcgaccactgtcgt

SEQ ID NO: 7736 - DNA, 22 bp, Artificial Sequence
  Synthetic construct
ctatgtagcgaccactgtcgtg

SEQ ID NO: 7737 - DNA, 22 bp, Artificial Sequence
  Synthetic construct
tatgtagcgaccactgtcgtgc

SEQ ID NO: 7738 - DNA, 22 bp, Artificial Sequence
  Synthetic construct
atgtagcgaccactgtcgtgct

SEQ ID NO: 7739 - DNA, 22 bp, Artificial Sequence
  Synthetic construct
tgtagcgaccactgtcgtgctt

SEQ ID NO: 7740 - DNA, 22 bp, Artificial Sequence
  Synthetic construct
gtagcgaccactgtcgtgcttt

SEQ ID NO: 7741 - DNA, 22 bp, Artificial Sequence
  Synthetic construct
tagcgaccactgtcgtgctttt

SEQ ID NO: 7742 - DNA, 22 bp, Artificial Sequence
  Synthetic construct
agcgaccactgtcgtgcttttc

SEQ ID NO: 7743 - DNA, 22 bp, Artificial Sequence
  Synthetic construct
gcgaccactgtcgtgcttttcg

SEQ ID NO: 7744 - DNA, 22 bp, Artificial Sequence
  Synthetic construct
cgaccactgtcgtgcttttcgc

SEQ ID NO: 7745 - DNA, 22 bp, Artificial Sequence
  Synthetic construct
gaccactgtcgtgcttttcgct

SEQ ID NO: 7746 - DNA, 22 bp, Artificial Sequence
  Synthetic construct
accactgtcgtgcttttcgctg

SEQ ID NO: 7747 - DNA, 22 bp, Artificial Sequence
  Synthetic construct
ccactgtcgtgcttttcgctga

SEQ ID NO: 7748 - DNA, 22 bp, Artificial Sequence
  Synthetic construct
cactgtcgtgcttttcgctgaa

SEQ ID NO: 7749 - DNA, 22 bp, Artificial Sequence
  Synthetic construct
actgtcgtgcttttcgctgaag

SEQ ID NO: 7750 - DNA, 22 bp, Artificial Sequence
  Synthetic construct
ctgtcgtgcttttcgctgaaga

SEQ ID NO: 7751 - DNA, 22 bp, Artificial Sequence
  Synthetic construct
tgtcgtgcttttcgctgaagaa

SEQ ID NO: 7752 - DNA, 22 bp, Artificial Sequence
  Synthetic construct
gtcgtgcttttcgctgaagaac

SEQ ID NO: 7753 - DNA, 22 bp, Artificial Sequence
  Synthetic construct
tcgtgcttttcgctgaagaact

SEQ ID NO: 7754 - DNA, 22 bp, Artificial Sequence
  Synthetic construct
cgtgcttttcgctgaagaactt

SEQ ID NO: 7755 - DNA, 22 bp, Artificial Sequence
  Synthetic construct
gtgcttttcgctgaagaacttg

SEQ ID NO: 7756 - DNA, 22 bp, Artificial Sequence
  Synthetic construct
tgcttttcgctgaagaacttgc

SEQ ID NO: 7757 - DNA, 22 bp, Artificial Sequence
  Synthetic construct
gcttttcgctgaagaacttgcg

SEQ ID NO: 7758 - DNA, 22 bp, Artificial Sequence
  Synthetic construct
cttttcgctgaagaacttgcgt

SEQ ID NO: 7759 - DNA, 22 bp, Artificial Sequence
  Synthetic construct
ttttcgctgaagaacttgcgtt

SEQ ID NO: 7760 - DNA, 22 bp, Artificial Sequence
  Synthetic construct
tttcgctgaagaacttgcgttc

SEQ ID NO: 7761 - DNA, 22 bp, Artificial Sequence
  Synthetic construct
ttcgctgaagaacttgcgttct

SEQ ID NO: 7762 - DNA, 22 bp, Artificial Sequence
  Synthetic construct
tcgctgaagaacttgcgttctc

SEQ ID NO: 7763 - DNA, 22 bp, Artificial Sequence
  Synthetic construct
cgctgaagaacttgcgttctcg

SEQ ID NO: 7764 - DNA, 22 bp, Artificial Sequence
  Synthetic construct
gctgaagaacttgcgttctcga

SEQ ID NO: 7765 - DNA, 22 bp, Artificial Sequence
  Synthetic construct
ctgaagaacttgcgttctcgag

SEQ ID NO: 7766 - DNA, 22 bp, Artificial Sequence
  Synthetic construct
tgaagaacttgcgttctcgagc

SEQ ID NO: 7767 - DNA, 22 bp, Artificial Sequence
  Synthetic construct
gaagaacttgcgttctcgagcg

SEQ ID NO: 7768 - DNA, 22 bp, Artificial Sequence
  Synthetic construct
aagaacttgcgttctcgagcga

SEQ ID NO: 7769 - DNA, 22 bp, Artificial Sequence
  Synthetic construct
agaacttgcgttctcgagcgat

SEQ ID NO: 7770 - DNA, 22 bp, Artificial Sequence
  Synthetic construct
gaacttgcgttctcgagcgata

SEQ ID NO: 7771 - DNA, 22 bp, Artificial Sequence
  Synthetic construct
aacttgcgttctcgagcgatac

SEQ ID NO: 7772 - DNA, 22 bp, Artificial Sequence
  Synthetic construct
acttgcgttctcgagcgatacg

SEQ ID NO: 7773 - DNA, 22 bp, Artificial Sequence
  Synthetic construct
cttgcgttctcgagcgatacga

SEQ ID NO: 7774 - DNA, 22 bp, Artificial Sequence
  Synthetic construct
ttgcgttctcgagcgatacgag

SEQ ID NO: 7775 - DNA, 22 bp, Artificial Sequence
  Synthetic construct
tgcgttctcgagcgatacgagc

SEQ ID NO: 7776 - DNA, 22 bp, Artificial Sequence
  Synthetic construct
gcgttctcgagcgatacgagca

SEQ ID NO: 7777 - DNA, 22 bp, Artificial Sequence
  Synthetic construct
cgttctcgagcgatacgagcaa

SEQ ID NO: 7778 - DNA, 22 bp, Artificial Sequence
  Synthetic construct
gttctcgagcgatacgagcaag

SEQ ID NO: 7779 - DNA, 22 bp, Artificial Sequence
  Synthetic construct
ttctcgagcgatacgagcaaga

SEQ ID NO: 7780 - DNA, 22 bp, Artificial Sequence
  Synthetic construct
tctcgagcgatacgagcaagac

SEQ ID NO: 7781 - DNA, 22 bp, Artificial Sequence
  Synthetic construct
ctcgagcgatacgagcaagacg

SEQ ID NO: 7782 - DNA, 22 bp, Artificial Sequence
  Synthetic construct
tcgagcgatacgagcaagacgg

SEQ ID NO: 7783 - DNA, 22 bp, Artificial Sequence
  Synthetic construct
cgagcgatacgagcaagacgga

SEQ ID NO: 7784 - DNA, 22 bp, Artificial Sequence
  Synthetic construct
gagcgatacgagcaagacggaa

SEQ ID NO: 7785 - DNA, 22 bp, Artificial Sequence
  Synthetic construct
agcgatacgagcaagacggaaa

SEQ ID NO: 7786 - DNA, 22 bp, Artificial Sequence
  Synthetic construct
gcgatacgagcaagacggaaac

SEQ ID NO: 7787 - DNA, 22 bp, Artificial Sequence
  Synthetic construct
cgatacgagcaagacggaaacc

SEQ ID NO: 7788 - DNA, 22 bp, Artificial Sequence
  Synthetic construct
gatacgagcaagacggaaaccc

SEQ ID NO: 7789 - DNA, 22 bp, Artificial Sequence
  Synthetic construct
atacgagcaagacggaaacccg

SEQ ID NO: 7790 - DNA, 22 bp, Artificial Sequence
  Synthetic construct
tacgagcaagacggaaacccga

SEQ ID NO: 7791 - DNA, 22 bp, Artificial Sequence
  Synthetic construct
acgagcaagacggaaacccgag

SEQ ID NO: 7792 - DNA, 22 bp, Artificial Sequence
  Synthetic construct
cgagcaagacggaaacccgagg

SEQ ID NO: 7793 - DNA, 22 bp, Artificial Sequence
  Synthetic construct
gagcaagacggaaacccgaggt

SEQ ID NO: 7794 - DNA, 22 bp, Artificial Sequence
  Synthetic construct
agcaagacggaaacccgaggta

SEQ ID NO: 7795 - DNA, 22 bp, Artificial Sequence
  Synthetic construct
gcaagacggaaacccgaggtac

SEQ ID NO: 7796 - DNA, 22 bp, Artificial Sequence
  Synthetic construct
caagacggaaacccgaggtacg

SEQ ID NO: 7797 - DNA, 22 bp, Artificial Sequence
  Synthetic construct
aagacggaaacccgaggtacgg

SEQ ID NO: 7798 - DNA, 22 bp, Artificial Sequence
  Synthetic construct
agacggaaacccgaggtacggg

SEQ ID NO: 7799 - DNA, 22 bp, Artificial Sequence
  Synthetic construct
gacggaaacccgaggtacgggt

SEQ ID NO: 7800 - DNA, 22 bp, Artificial Sequence
  Synthetic construct
acggaaacccgaggtacgggta

SEQ ID NO: 7801 - DNA, 22 bp, Artificial Sequence
  Synthetic construct
cggaaacccgaggtacgggtat

SEQ ID NO: 7802 - DNA, 22 bp, Artificial Sequence
  Synthetic construct
ggaaacccgaggtacgggtatc

SEQ ID NO: 7803 - DNA, 22 bp, Artificial Sequence
  Synthetic construct
gaaacccgaggtacgggtatcc

SEQ ID NO: 7804 - DNA, 22 bp, Artificial Sequence
  Synthetic construct
aaacccgaggtacgggtatccg

SEQ ID NO: 7805 - DNA, 22 bp, Artificial Sequence
  Synthetic construct
aacccgaggtacgggtatccgc

SEQ ID NO: 7806 - DNA, 22 bp, Artificial Sequence
  Synthetic construct
acccgaggtacgggtatccgcg

SEQ ID NO: 7807 - DNA, 22 bp, Artificial Sequence
  Synthetic construct
cccgaggtacgggtatccgcga

SEQ ID NO: 7808 - DNA, 22 bp, Artificial Sequence
  Synthetic construct
ccgaggtacgggtatccgcgag

SEQ ID NO: 7809 - DNA, 22 bp, Artificial Sequence
  Synthetic construct
cgaggtacgggtatccgcgagc

SEQ ID NO: 7810 - DNA, 22 bp, Artificial Sequence
  Synthetic construct
gaggtacgggtatccgcgagca

SEQ ID NO: 7811 - DNA, 22 bp, Artificial Sequence
  Synthetic construct
aggtacgggtatccgcgagcag

SEQ ID NO: 7812 - DNA, 22 bp, Artificial Sequence
  Synthetic construct
ggtacgggtatccgcgagcagc

SEQ ID NO: 7813 - DNA, 22 bp, Artificial Sequence
  Synthetic construct
gtacgggtatccgcgagcagcc

SEQ ID NO: 7814 - DNA, 22 bp, Artificial Sequence
  Synthetic construct
tacgggtatccgcgagcagccg

SEQ ID NO: 7815 - DNA, 22 bp, Artificial Sequence
  Synthetic construct
acgggtatccgcgagcagccgc

SEQ ID NO: 7816 - DNA, 22 bp, Artificial Sequence
  Synthetic construct
cgggtatccgcgagcagccgcc

SEQ ID NO: 7817 - DNA, 22 bp, Artificial Sequence
  Synthetic construct
gggtatccgcgagcagccgccc

SEQ ID NO: 7818 - DNA, 22 bp, Artificial Sequence
  Synthetic construct
ggtatccgcgagcagccgcccg

SEQ ID NO: 7819 - DNA, 22 bp, Artificial Sequence
  Synthetic construct
gtatccgcgagcagccgcccgt

SEQ ID NO: 7820 - DNA, 22 bp, Artificial Sequence
  Synthetic construct
tatccgcgagcagccgcccgta

SEQ ID NO: 7821 - DNA, 22 bp, Artificial Sequence
  Synthetic construct
atccgcgagcagccgcccgtac

SEQ ID NO: 7822 - DNA, 22 bp, Artificial Sequence
  Synthetic construct
tccgcgagcagccgcccgtacg

SEQ ID NO: 7823 - DNA, 22 bp, Artificial Sequence
  Synthetic construct
ccgcgagcagccgcccgtacgg

SEQ ID NO: 7824 - DNA, 22 bp, Artificial Sequence
  Synthetic construct
cgcgagcagccgcccgtacgga

SEQ ID NO: 7825 - DNA, 22 bp, Artificial Sequence
  Synthetic construct
gcgagcagccgcccgtacggag

SEQ ID NO: 7826 - DNA, 22 bp, Artificial Sequence
  Synthetic construct
cgagcagccgcccgtacggagt

SEQ ID NO: 7827 - DNA, 22 bp, Artificial Sequence
  Synthetic construct
gagcagccgcccgtacggagtc

SEQ ID NO: 7828 - DNA, 22 bp, Artificial Sequence
  Synthetic construct
agcagccgcccgtacggagtct

SEQ ID NO: 7829 - DNA, 22 bp, Artificial Sequence
  Synthetic construct
gcagccgcccgtacggagtctt

SEQ ID NO: 7830 - DNA, 22 bp, Artificial Sequence
  Synthetic construct
cagccgcccgtacggagtcttg

SEQ ID NO: 7831 - DNA, 22 bp, Artificial Sequence
  Synthetic construct
agccgcccgtacggagtcttgg

SEQ ID NO: 7832 - DNA, 22 bp, Artificial Sequence
  Synthetic construct
gccgcccgtacggagtcttggt

SEQ ID NO: 7833 - DNA, 22 bp, Artificial Sequence
  Synthetic construct
ccgcccgtacggagtcttggtg

SEQ ID NO: 7834 - DNA, 22 bp, Artificial Sequence
  Synthetic construct
cgcccgtacggagtcttggtgt

SEQ ID NO: 7835 - DNA, 22 bp, Artificial Sequence
  Synthetic construct
gcccgtacggagtcttggtgta

SEQ ID NO: 7836 - DNA, 22 bp, Artificial Sequence
  Synthetic construct
cccgtacggagtcttggtgtat

SEQ ID NO: 7837 - DNA, 22 bp, Artificial Sequence
  Synthetic construct
ccgtacggagtcttggtgtata

SEQ ID NO: 7838 - DNA, 22 bp, Artificial Sequence
  Synthetic construct
cgtacggagtcttggtgtatac

SEQ ID NO: 7839 - DNA, 22 bp, Artificial Sequence
  Synthetic construct
gtacggagtcttggtgtatacc

SEQ ID NO: 7840 - DNA, 22 bp, Artificial Sequence
  Synthetic construct
tacggagtcttggtgtataccg

SEQ ID NO: 7841 - DNA, 22 bp, Artificial Sequence
  Synthetic construct
acggagtcttggtgtataccga

SEQ ID NO: 7842 - DNA, 22 bp, Artificial Sequence
  Synthetic construct
cggagtcttggtgtataccgag

SEQ ID NO: 7843 - DNA, 22 bp, Artificial Sequence
  Synthetic construct
ggagtcttggtgtataccgaga

SEQ ID NO: 7844 - DNA, 22 bp, Artificial Sequence
  Synthetic construct
gagtcttggtgtataccgagac

SEQ ID NO: 7845 - DNA, 22 bp, Artificial Sequence
  Synthetic construct
agtcttggtgtataccgagact

SEQ ID NO: 7846 - DNA, 22 bp, Artificial Sequence
  Synthetic construct
gtcttggtgtataccgagactg

SEQ ID NO: 7847 - DNA, 22 bp, Artificial Sequence
  Synthetic construct
tcttggtgtataccgagactgc

SEQ ID NO: 7848 - DNA, 22 bp, Artificial Sequence
  Synthetic construct
cttggtgtataccgagactgcc

SEQ ID NO: 7849 - DNA, 22 bp, Artificial Sequence
  Synthetic construct
ttggtgtataccgagactgccg

SEQ ID NO: 7850 - DNA, 22 bp, Artificial Sequence
  Synthetic construct
tggtgtataccgagactgccgt

SEQ ID NO: 7851 - DNA, 22 bp, Artificial Sequence
  Synthetic construct
ggtgtataccgagactgccgta

SEQ ID NO: 7852 - DNA, 22 bp, Artificial Sequence
  Synthetic construct
gtgtataccgagactgccgtag

SEQ ID NO: 7853 - DNA, 22 bp, Artificial Sequence
  Synthetic construct
tgtataccgagactgccgtagg

SEQ ID NO: 7854 - DNA, 22 bp, Artificial Sequence
  Synthetic construct
gtataccgagactgccgtaggc

SEQ ID NO: 7855 - DNA, 22 bp, Artificial Sequence
  Synthetic construct
tataccgagactgccgtaggcg

SEQ ID NO: 7856 - DNA, 22 bp, Artificial Sequence
  Synthetic construct
ataccgagactgccgtaggcgg

SEQ ID NO: 7857 - DNA, 22 bp, Artificial Sequence
  Synthetic construct
taccgagactgccgtaggcggg

SEQ ID NO: 7858 - DNA, 22 bp, Artificial Sequence
  Synthetic construct
accgagactgccgtaggcgggc

SEQ ID NO: 7859 - DNA, 22 bp, Artificial Sequence
  Synthetic construct
ccgagactgccgtaggcgggct

SEQ ID NO: 7860 - DNA, 22 bp, Artificial Sequence
  Synthetic construct
cgagactgccgtaggcgggctg

SEQ ID NO: 7861 - DNA, 22 bp, Artificial Sequence
  Synthetic construct
gagactgccgtaggcgggctga

SEQ ID NO: 7862 - DNA, 22 bp, Artificial Sequence
  Synthetic construct
agactgccgtaggcgggctgac

SEQ ID NO: 7863 - DNA, 22 bp, Artificial Sequence
  Synthetic construct
gactgccgtaggcgggctgact

SEQ ID NO: 7864 - DNA, 22 bp, Artificial Sequence
  Synthetic construct
actgccgtaggcgggctgacta

SEQ ID NO: 7865 - DNA, 22 bp, Artificial Sequence
  Synthetic construct
ctgccgtaggcgggctgactac

SEQ ID NO: 7866 - DNA, 22 bp, Artificial Sequence
  Synthetic construct
tgccgtaggcgggctgactacg

SEQ ID NO: 7867 - DNA, 22 bp, Artificial Sequence
  Synthetic construct
gccgtaggcgggctgactacgt

SEQ ID NO: 7868 - DNA, 22 bp, Artificial Sequence
  Synthetic construct
ccgtaggcgggctgactacgta

SEQ ID NO: 7869 - DNA, 22 bp, Artificial Sequence
  Synthetic construct
cgtaggcgggctgactacgtag

SEQ ID NO: 7870 - DNA, 22 bp, Artificial Sequence
  Synthetic construct
gtaggcgggctgactacgtagt

SEQ ID NO: 7871 - DNA, 22 bp, Artificial Sequence
  Synthetic construct
taggcgggctgactacgtagta

SEQ ID NO: 7872 - DNA, 22 bp, Artificial Sequence
  Synthetic construct
aggcgggctgactacgtagtag

SEQ ID NO: 7873 - DNA, 22 bp, Artificial Sequence
  Synthetic construct
ggcgggctgactacgtagtagt

SEQ ID NO: 7874 - DNA, 22 bp, Artificial Sequence
  Synthetic construct
gcgggctgactacgtagtagtc

SEQ ID NO: 7875 - DNA, 22 bp, Artificial Sequence
  Synthetic construct
cgggctgactacgtagtagtcg

SEQ ID NO: 7876 - DNA, 22 bp, Artificial Sequence
  Synthetic construct
gggctgactacgtagtagtcgg

SEQ ID NO: 7877 - DNA, 22 bp, Artificial Sequence
  Synthetic construct
ggctgactacgtagtagtcggc

SEQ ID NO: 7878 - DNA, 22 bp, Artificial Sequence
  Synthetic construct
gctgactacgtagtagtcggca

SEQ ID NO: 7879 - DNA, 22 bp, Artificial Sequence
  Synthetic construct
ctgactacgtagtagtcggcag

SEQ ID NO: 7880 - DNA, 22 bp, Artificial Sequence
  Synthetic construct
tgactacgtagtagtcggcagc

SEQ ID NO: 7881 - DNA, 22 bp, Artificial Sequence
  Synthetic construct
gactacgtagtagtcggcagcg

SEQ ID NO: 7882 - DNA, 22 bp, Artificial Sequence
  Synthetic construct
actacgtagtagtcggcagcga

SEQ ID NO: 7883 - DNA, 22 bp, Artificial Sequence
  Synthetic construct
ctacgtagtagtcggcagcgag

SEQ ID NO: 7884 - DNA, 22 bp, Artificial Sequence
  Synthetic construct
tacgtagtagtcggcagcgagg

SEQ ID NO: 7885 - DNA, 22 bp, Artificial Sequence
  Synthetic construct
acgtagtagtcggcagcgaggt

SEQ ID NO: 7886 - DNA, 22 bp, Artificial Sequence
  Synthetic construct
cgtagtagtcggcagcgaggtc

SEQ ID NO: 7887 - DNA, 22 bp, Artificial Sequence
  Synthetic construct
gtagtagtcggcagcgaggtcc

SEQ ID NO: 7888 - DNA, 22 bp, Artificial Sequence
  Synthetic construct
tagtagtcggcagcgaggtccg

SEQ ID NO: 7889 - DNA, 22 bp, Artificial Sequence
  Synthetic construct
agtagtcggcagcgaggtccgt

SEQ ID NO: 7890 - DNA, 22 bp, Artificial Sequence
  Synthetic construct
gtagtcggcagcgaggtccgtc

SEQ ID NO: 7891 - DNA, 22 bp, Artificial Sequence
  Synthetic construct
tagtcggcagcgaggtccgtcc

SEQ ID NO: 7892 - DNA, 22 bp, Artificial Sequence
  Synthetic construct
agtcggcagcgaggtccgtccc

SEQ ID NO: 7893 - DNA, 22 bp, Artificial Sequence
  Synthetic construct
gtcggcagcgaggtccgtccca

SEQ ID NO: 7894 - DNA, 22 bp, Artificial Sequence
  Synthetic construct
tcggcagcgaggtccgtcccac

SEQ ID NO: 7895 - DNA, 22 bp, Artificial Sequence
  Synthetic construct
cggcagcgaggtccgtcccacc

SEQ ID NO: 7896 - DNA, 22 bp, Artificial Sequence
  Synthetic construct
ggcagcgaggtccgtcccaccg

SEQ ID NO: 7897 - DNA, 22 bp, Artificial Sequence
  Synthetic construct
gcagcgaggtccgtcccaccga

SEQ ID NO: 7898 - DNA, 22 bp, Artificial Sequence
  Synthetic construct
cagcgaggtccgtcccaccgaa

SEQ ID NO: 7899 - DNA, 22 bp, Artificial Sequence
  Synthetic construct
agcgaggtccgtcccaccgaag

SEQ ID NO: 7900 - DNA, 22 bp, Artificial Sequence
  Synthetic construct
gcgaggtccgtcccaccgaaga

SEQ ID NO: 7901 - DNA, 22 bp, Artificial Sequence
  Synthetic construct
cgaggtccgtcccaccgaagaa

SEQ ID NO: 7902 - DNA, 22 bp, Artificial Sequence
  Synthetic construct
gaggtccgtcccaccgaagaac

SEQ ID NO: 7903 - DNA, 22 bp, Artificial Sequence
  Synthetic construct
aggtccgtcccaccgaagaaca

SEQ ID NO: 7904 - DNA, 22 bp, Artificial Sequence
  Synthetic construct
ggtccgtcccaccgaagaacat

SEQ ID NO: 7905 - DNA, 22 bp, Artificial Sequence
  Synthetic construct
gtccgtcccaccgaagaacatc

SEQ ID NO: 7906 - DNA, 22 bp, Artificial Sequence
  Synthetic construct
tccgtcccaccgaagaacatcg

SEQ ID NO: 7907 - DNA, 22 bp, Artificial Sequence
  Synthetic construct
ccgtcccaccgaagaacatcga

SEQ ID NO: 7908 - DNA, 22 bp, Artificial Sequence
  Synthetic construct
cgtcccaccgaagaacatcgaa

SEQ ID NO: 7909 - DNA, 22 bp, Artificial Sequence
  Synthetic construct
gtcccaccgaagaacatcgaag

SEQ ID NO: 7910 - DNA, 22 bp, Artificial Sequence
  Synthetic construct
tcccaccgaagaacatcgaagg

SEQ ID NO: 7911 - DNA, 22 bp, Artificial Sequence
  Synthetic construct
cccaccgaagaacatcgaaggc

SEQ ID NO: 7912 - DNA, 22 bp, Artificial Sequence
  Synthetic construct
ccaccgaagaacatcgaaggca

SEQ ID NO: 7913 - DNA, 22 bp, Artificial Sequence
  Synthetic construct
caccgaagaacatcgaaggcac

SEQ ID NO: 7914 - DNA, 22 bp, Artificial Sequence
  Synthetic construct
accgaagaacatcgaaggcacc

SEQ ID NO: 7915 - DNA, 22 bp, Artificial Sequence
  Synthetic construct
ccgaagaacatcgaaggcacct

SEQ ID NO: 7916 - DNA, 22 bp, Artificial Sequence
  Synthetic construct
cgaagaacatcgaaggcacctg

SEQ ID NO: 7917 - DNA, 22 bp, Artificial Sequence
  Synthetic construct
gaagaacatcgaaggcacctgg

SEQ ID NO: 7918 - DNA, 22 bp, Artificial Sequence
  Synthetic construct
aagaacatcgaaggcacctggg

SEQ ID NO: 7919 - DNA, 22 bp, Artificial Sequence
  Synthetic construct
agaacatcgaaggcacctggga

SEQ ID NO: 7920 - DNA, 22 bp, Artificial Sequence
  Synthetic construct
gaacatcgaaggcacctgggag

SEQ ID NO: 7921 - DNA, 22 bp, Artificial Sequence
  Synthetic construct
aacatcgaaggcacctgggagg

SEQ ID NO: 7922 - DNA, 22 bp, Artificial Sequence
  Synthetic construct
acatcgaaggcacctgggagga

SEQ ID NO: 7923 - DNA, 22 bp, Artificial Sequence
  Synthetic construct
catcgaaggcacctgggaggag

SEQ ID NO: 7924 - DNA, 22 bp, Artificial Sequence
  Synthetic construct
atcgaaggcacctgggaggaga

SEQ ID NO: 7925 - DNA, 22 bp, Artificial Sequence
  Synthetic construct
tcgaaggcacctgggaggagag

SEQ ID NO: 7926 - DNA, 22 bp, Artificial Sequence
  Synthetic construct
cgaaggcacctgggaggagagc

SEQ ID NO: 7927 - DNA, 22 bp, Artificial Sequence
  Synthetic construct
gaaggcacctgggaggagagcc

SEQ ID NO: 7928 - DNA, 22 bp, Artificial Sequence
  Synthetic construct
aaggcacctgggaggagagccg

SEQ ID NO: 7929 - DNA, 22 bp, Artificial Sequence
  Synthetic construct
aggcacctgggaggagagccgt

SEQ ID NO: 7930 - DNA, 22 bp, Artificial Sequence
  Synthetic construct
ggcacctgggaggagagccgta

SEQ ID NO: 7931 - DNA, 22 bp, Artificial Sequence
  Synthetic construct
gcacctgggaggagagccgtac

SEQ ID NO: 7932 - DNA, 22 bp, Artificial Sequence
  Synthetic construct
cacctgggaggagagccgtacc

SEQ ID NO: 7933 - DNA, 22 bp, Artificial Sequence
  Synthetic construct
acctgggaggagagccgtaccc

SEQ ID NO: 7934 - DNA, 22 bp, Artificial Sequence
  Synthetic construct
cctgggaggagagccgtaccca

SEQ ID NO: 7935 - DNA, 22 bp, Artificial Sequence
  Synthetic construct
ctgggaggagagccgtacccac

SEQ ID NO: 7936 - DNA, 22 bp, Artificial Sequence
  Synthetic construct
tgggaggagagccgtacccaca

SEQ ID NO: 7937 - DNA, 22 bp, Artificial Sequence
  Synthetic construct
gggaggagagccgtacccacac

SEQ ID NO: 7938 - DNA, 22 bp, Artificial Sequence
  Synthetic construct
ggaggagagccgtacccacacc

SEQ ID NO: 7939 - DNA, 22 bp, Artificial Sequence
  Synthetic construct
gaggagagccgtacccacacct

SEQ ID NO: 7940 - DNA, 22 bp, Artificial Sequence
  Synthetic construct
aggagagccgtacccacacctt

SEQ ID NO: 7941 - DNA, 22 bp, Artificial Sequence
  Synthetic construct
ggagagccgtacccacacctta

SEQ ID NO: 7942 - DNA, 22 bp, Artificial Sequence
  Synthetic construct
gagagccgtacccacaccttat

SEQ ID NO: 7943 - DNA, 22 bp, Artificial Sequence
  Synthetic construct
agagccgtacccacaccttata

SEQ ID NO: 7944 - DNA, 22 bp, Artificial Sequence
  Synthetic construct
gagccgtacccacaccttatag

SEQ ID NO: 7945 - DNA, 22 bp, Artificial Sequence
  Synthetic construct
agccgtacccacaccttataga

SEQ ID NO: 7946 - DNA, 22 bp, Artificial Sequence
  Synthetic construct
gccgtacccacaccttatagag

SEQ ID NO: 7947 - DNA, 22 bp, Artificial Sequence
  Synthetic construct
ccgtacccacaccttatagagg

SEQ ID NO: 7948 - DNA, 22 bp, Artificial Sequence
  Synthetic construct
cgtacccacaccttatagaggc

SEQ ID NO: 7949 - DNA, 22 bp, Artificial Sequence
  Synthetic construct
gtacccacaccttatagaggcg

SEQ ID NO: 7950 - DNA, 22 bp, Artificial Sequence
  Synthetic construct
tacccacaccttatagaggcgt

SEQ ID NO: 7951 - DNA, 22 bp, Artificial Sequence
  Synthetic construct
acccacaccttatagaggcgtg

SEQ ID NO: 7952 - DNA, 22 bp, Artificial Sequence
  Synthetic construct
cccacaccttatagaggcgtgg

SEQ ID NO: 7953 - DNA, 22 bp, Artificial Sequence
  Synthetic construct
ccacaccttatagaggcgtgga

SEQ ID NO: 7954 - DNA, 22 bp, Artificial Sequence
  Synthetic construct
cacaccttatagaggcgtggat

SEQ ID NO: 7955 - DNA, 22 bp, Artificial Sequence
  Synthetic construct
acaccttatagaggcgtggatc

SEQ ID NO: 7956 - DNA, 22 bp, Artificial Sequence
  Synthetic construct
caccttatagaggcgtggatct

SEQ ID NO: 7957 - DNA, 22 bp, Artificial Sequence
  Synthetic construct
accttatagaggcgtggatctg

SEQ ID NO: 7958 - DNA, 22 bp, Artificial Sequence
  Synthetic construct
ccttatagaggcgtggatctga

SEQ ID NO: 7959 - DNA, 22 bp, Artificial Sequence
  Synthetic construct
cttatagaggcgtggatctgac

SEQ ID NO: 7960 - DNA, 22 bp, Artificial Sequence
  Synthetic construct
ttatagaggcgtggatctgaca

SEQ ID NO: 7961 - DNA, 22 bp, Artificial Sequence
  Synthetic construct
tatagaggcgtggatctgacat

SEQ ID NO: 7962 - DNA, 22 bp, Artificial Sequence
  Synthetic construct
atagaggcgtggatctgacata

SEQ ID NO: 7963 - DNA, 22 bp, Artificial Sequence
  Synthetic construct
tagaggcgtggatctgacatac

SEQ ID NO: 7964 - DNA, 22 bp, Artificial Sequence
  Synthetic construct
agaggcgtggatctgacatacc

SEQ ID NO: 7965 - DNA, 22 bp, Artificial Sequence
  Synthetic construct
gaggcgtggatctgacatacct

SEQ ID NO: 7966 - DNA, 22 bp, Artificial Sequence
  Synthetic construct
aggcgtggatctgacatacctc

SEQ ID NO: 7967 - DNA, 22 bp, Artificial Sequence
  Synthetic construct
ggcgtggatctgacatacctcc

SEQ ID NO: 7968 - DNA, 22 bp, Artificial Sequence
  Synthetic construct
gcgtggatctgacatacctccg

SEQ ID NO: 7969 - DNA, 22 bp, Artificial Sequence
  Synthetic construct
cgtggatctgacatacctccga

SEQ ID NO: 7970 - DNA, 22 bp, Artificial Sequence
  Synthetic construct
gtggatctgacatacctccgac

SEQ ID NO: 7971 - DNA, 22 bp, Artificial Sequence
  Synthetic construct
tggatctgacatacctccgaca

SEQ ID NO: 7972 - DNA, 22 bp, Artificial Sequence
  Synthetic construct
ggatctgacatacctccgacaa

SEQ ID NO: 7973 - DNA, 22 bp, Artificial Sequence
  Synthetic construct
gatctgacatacctccgacaac

SEQ ID NO: 7974 - DNA, 22 bp, Artificial Sequence
  Synthetic construct
atctgacatacctccgacaact

SEQ ID NO: 7975 - DNA, 22 bp, Artificial Sequence
  Synthetic construct
tctgacatacctccgacaactc

SEQ ID NO: 7976 - DNA, 22 bp, Artificial Sequence
  Synthetic construct
ctgacatacctccgacaactcc

SEQ ID NO: 7977 - DNA, 22 bp, Artificial Sequence
  Synthetic construct
tgacatacctccgacaactccc

SEQ ID NO: 7978 - DNA, 22 bp, Artificial Sequence
  Synthetic construct
gacatacctccgacaactcccc

SEQ ID NO: 7979 - DNA, 22 bp, Artificial Sequence
  Synthetic construct
acatacctccgacaactcccca

SEQ ID NO: 7980 - DNA, 22 bp, Artificial Sequence
  Synthetic construct
catacctccgacaactccccaa

SEQ ID NO: 7981 - DNA, 22 bp, Artificial Sequence
  Synthetic construct
atacctccgacaactccccaac

SEQ ID NO: 7982 - DNA, 22 bp, Artificial Sequence
  Synthetic construct
tacctccgacaactccccaacc

SEQ ID NO: 7983 - DNA, 22 bp, Artificial Sequence
  Synthetic construct
acctccgacaactccccaaccc

SEQ ID NO: 7984 - DNA, 22 bp, Artificial Sequence
  Synthetic construct
cctccgacaactccccaacccc

SEQ ID NO: 7985 - DNA, 22 bp, Artificial Sequence
  Synthetic construct
ctccgacaactccccaaccccg

SEQ ID NO: 7986 - DNA, 22 bp, Artificial Sequence
  Synthetic construct
tccgacaactccccaaccccgt

SEQ ID NO: 7987 - DNA, 22 bp, Artificial Sequence
  Synthetic construct
ccgacaactccccaaccccgta

SEQ ID NO: 7988 - DNA, 22 bp, Artificial Sequence
  Synthetic construct
cgacaactccccaaccccgtag

SEQ ID NO: 7989 - DNA, 22 bp, Artificial Sequence
  Synthetic construct
gacaactccccaaccccgtagc

SEQ ID NO: 7990 - DNA, 22 bp, Artificial Sequence
  Synthetic construct
acaactccccaaccccgtagcc

SEQ ID NO: 7991 - DNA, 22 bp, Artificial Sequence
  Synthetic construct
caactccccaaccccgtagccg

SEQ ID NO: 7992 - DNA, 22 bp, Artificial Sequence
  Synthetic construct
aactccccaaccccgtagccga

SEQ ID NO: 7993 - DNA, 22 bp, Artificial Sequence
  Synthetic construct
actccccaaccccgtagccgat

SEQ ID NO: 7994 - DNA, 22 bp, Artificial Sequence
  Synthetic construct
ctccccaaccccgtagccgatt

SEQ ID NO: 7995 - DNA, 22 bp, Artificial Sequence
  Synthetic construct
tccccaaccccgtagccgattt

SEQ ID NO: 7996 - DNA, 22 bp, Artificial Sequence
  Synthetic construct
ccccaaccccgtagccgattta

SEQ ID NO: 7997 - DNA, 22 bp, Artificial Sequence
  Synthetic construct
cccaaccccgtagccgatttaa

SEQ ID NO: 7998 - DNA, 22 bp, Artificial Sequence
  Synthetic construct
ccaaccccgtagccgatttaat

SEQ ID NO: 7999 - DNA, 22 bp, Artificial Sequence
  Synthetic construct
caaccccgtagccgatttaata

SEQ ID NO: 8000 - DNA, 22 bp, Artificial Sequence
  Synthetic construct
aaccccgtagccgatttaatat

SEQ ID NO: 8001 - DNA, 22 bp, Artificial Sequence
  Synthetic construct
accccgtagccgatttaatatc

SEQ ID NO: 8002 - DNA, 22 bp, Artificial Sequence
  Synthetic construct
ccccgtagccgatttaatatca

SEQ ID NO: 8003 - DNA, 22 bp, Artificial Sequence
  Synthetic construct
cccgtagccgatttaatatcag

SEQ ID NO: 8004 - DNA, 22 bp, Artificial Sequence
  Synthetic construct
ccgtagccgatttaatatcagc

SEQ ID NO: 8005 - DNA, 22 bp, Artificial Sequence
  Synthetic construct
cgtagccgatttaatatcagca

SEQ ID NO: 8006 - DNA, 22 bp, Artificial Sequence
  Synthetic construct
gtagccgatttaatatcagcat

SEQ ID NO: 8007 - DNA, 22 bp, Artificial Sequence
  Synthetic construct
tagccgatttaatatcagcatc

SEQ ID NO: 8008 - DNA, 22 bp, Artificial Sequence
  Synthetic construct
agccgatttaatatcagcatca

SEQ ID NO: 8009 - DNA, 22 bp, Artificial Sequence
  Synthetic construct
gccgatttaatatcagcatcag

SEQ ID NO: 8010 - DNA, 22 bp, Artificial Sequence
  Synthetic construct
ccgatttaatatcagcatcagg

SEQ ID NO: 8011 - DNA, 22 bp, Artificial Sequence
  Synthetic construct
cgatttaatatcagcatcaggg

SEQ ID NO: 8012 - DNA, 22 bp, Artificial Sequence
  Synthetic construct
gatttaatatcagcatcagggc

SEQ ID NO: 8013 - DNA, 22 bp, Artificial Sequence
  Synthetic construct
atttaatatcagcatcagggcg

SEQ ID NO: 8014 - DNA, 22 bp, Artificial Sequence
  Synthetic construct
tttaatatcagcatcagggcga

SEQ ID NO: 8015 - DNA, 22 bp, Artificial Sequence
  Synthetic construct
ttaatatcagcatcagggcgaa

SEQ ID NO: 8016 - DNA, 22 bp, Artificial Sequence
  Synthetic construct
taatatcagcatcagggcgaag

SEQ ID NO: 8017 - DNA, 22 bp, Artificial Sequence
  Synthetic construct
aatatcagcatcagggcgaaga

SEQ ID NO: 8018 - DNA, 22 bp, Artificial Sequence
  Synthetic construct
atatcagcatcagggcgaagag

SEQ ID NO: 8019 - DNA, 22 bp, Artificial Sequence
  Synthetic construct
tatcagcatcagggcgaagaga

SEQ ID NO: 8020 - DNA, 22 bp, Artificial Sequence
  Synthetic construct
atcagcatcagggcgaagagat

SEQ ID NO: 8021 - DNA, 22 bp, Artificial Sequence
  Synthetic construct
tcagcatcagggcgaagagatt

SEQ ID NO: 8022 - DNA, 22 bp, Artificial Sequence
  Synthetic construct
cagcatcagggcgaagagattg

SEQ ID NO: 8023 - DNA, 22 bp, Artificial Sequence
  Synthetic construct
agcatcagggcgaagagattgt

SEQ ID NO: 8024 - DNA, 22 bp, Artificial Sequence
  Synthetic construct
gcatcagggcgaagagattgtc

SEQ ID NO: 8025 - DNA, 22 bp, Artificial Sequence
  Synthetic construct
catcagggcgaagagattgtca

SEQ ID NO: 8026 - DNA, 22 bp, Artificial Sequence
  Synthetic construct
atcagggcgaagagattgtcaa

SEQ ID NO: 8027 - DNA, 22 bp, Artificial Sequence
  Synthetic construct
tcagggcgaagagattgtcaac

SEQ ID NO: 8028 - DNA, 22 bp, Artificial Sequence
  Synthetic construct
cagggcgaagagattgtcaaca

SEQ ID NO: 8029 - DNA, 22 bp, Artificial Sequence
  Synthetic construct
agggcgaagagattgtcaacag

SEQ ID NO: 8030 - DNA, 22 bp, Artificial Sequence
  Synthetic construct
gggcgaagagattgtcaacagg

SEQ ID NO: 8031 - DNA, 22 bp, Artificial Sequence
  Synthetic construct
ggcgaagagattgtcaacaggt

SEQ ID NO: 8032 - DNA, 22 bp, Artificial Sequence
  Synthetic construct
gcgaagagattgtcaacaggtt

SEQ ID NO: 8033 - DNA, 22 bp, Artificial Sequence
  Synthetic construct
cgaagagattgtcaacaggttt

SEQ ID NO: 8034 - DNA, 22 bp, Artificial Sequence
  Synthetic construct
gaagagattgtcaacaggtttc

SEQ ID NO: 8035 - DNA, 22 bp, Artificial Sequence
  Synthetic construct
aagagattgtcaacaggtttct

SEQ ID NO: 8036 - DNA, 22 bp, Artificial Sequence
  Synthetic construct
agagattgtcaacaggtttctt

SEQ ID NO: 8037 - DNA, 22 bp, Artificial Sequence
  Synthetic construct
gagattgtcaacaggtttcttg

SEQ ID NO: 8038 - DNA, 22 bp, Artificial Sequence
  Synthetic construct
agattgtcaacaggtttcttga

SEQ ID NO: 8039 - DNA, 22 bp, Artificial Sequence
  Synthetic construct
gattgtcaacaggtttcttgat

SEQ ID NO: 8040 - DNA, 22 bp, Artificial Sequence
  Synthetic construct
attgtcaacaggtttcttgatg

SEQ ID NO: 8041 - DNA, 22 bp, Artificial Sequence
  Synthetic construct
ttgtcaacaggtttcttgatgt

SEQ ID NO: 8042 - DNA, 22 bp, Artificial Sequence
  Synthetic construct
tgtcaacaggtttcttgatgta

SEQ ID NO: 8043 - DNA, 22 bp, Artificial Sequence
  Synthetic construct
gtcaacaggtttcttgatgtaa

SEQ ID NO: 8044 - DNA, 22 bp, Artificial Sequence
  Synthetic construct
tcaacaggtttcttgatgtaaa

SEQ ID NO: 8045 - DNA, 22 bp, Artificial Sequence
  Synthetic construct
caacaggtttcttgatgtaaaa

SEQ ID NO: 8046 - DNA, 22 bp, Artificial Sequence
  Synthetic construct
aacaggtttcttgatgtaaaac

SEQ ID NO: 8047 - DNA, 22 bp, Artificial Sequence
  Synthetic construct
acaggtttcttgatgtaaaacg

SEQ ID NO: 8048 - DNA, 22 bp, Artificial Sequence
  Synthetic construct
caggtttcttgatgtaaaacgg

SEQ ID NO: 8049 - DNA, 22 bp, Artificial Sequence
  Synthetic construct
aggtttcttgatgtaaaacggt

SEQ ID NO: 8050 - DNA, 22 bp, Artificial Sequence
  Synthetic construct
ggtttcttgatgtaaaacggtt

SEQ ID NO: 8051 - DNA, 22 bp, Artificial Sequence
  Synthetic construct
gtttcttgatgtaaaacggttt

SEQ ID NO: 8052 - DNA, 22 bp, Artificial Sequence
  Synthetic construct
tttcttgatgtaaaacggtttg

SEQ ID NO: 8053 - DNA, 22 bp, Artificial Sequence
  Synthetic construct
ttcttgatgtaaaacggtttga

SEQ ID NO: 8054 - DNA, 22 bp, Artificial Sequence
  Synthetic construct
tcttgatgtaaaacggtttgac

SEQ ID NO: 8055 - DNA, 22 bp, Artificial Sequence
  Synthetic construct
cttgatgtaaaacggtttgaca

SEQ ID NO: 8056 - DNA, 22 bp, Artificial Sequence
  Synthetic construct
ttgatgtaaaacggtttgacat

SEQ ID NO: 8057 - DNA, 22 bp, Artificial Sequence
  Synthetic construct
tgatgtaaaacggtttgacatc

SEQ ID NO: 8058 - DNA, 22 bp, Artificial Sequence
  Synthetic construct
gatgtaaaacggtttgacatcg

SEQ ID NO: 8059 - DNA, 22 bp, Artificial Sequence
  Synthetic construct
atgtaaaacggtttgacatcga

SEQ ID NO: 8060 - DNA, 22 bp, Artificial Sequence
  Synthetic construct
tgtaaaacggtttgacatcgac

SEQ ID NO: 8061 - DNA, 22 bp, Artificial Sequence
  Synthetic construct
gtaaaacggtttgacatcgaca

SEQ ID NO: 8062 - DNA, 22 bp, Artificial Sequence
  Synthetic construct
taaaacggtttgacatcgacac

SEQ ID NO: 8063 - DNA, 22 bp, Artificial Sequence
  Synthetic construct
aaaacggtttgacatcgacacc

SEQ ID NO: 8064 - DNA, 22 bp, Artificial Sequence
  Synthetic construct
aaacggtttgacatcgacacca

SEQ ID NO: 8065 - DNA, 22 bp, Artificial Sequence
  Synthetic construct
aacggtttgacatcgacaccac

SEQ ID NO: 8066 - DNA, 22 bp, Artificial Sequence
  Synthetic construct
acggtttgacatcgacaccacg

SEQ ID NO: 8067 - DNA, 22 bp, Artificial Sequence
  Synthetic construct
cggtttgacatcgacaccacgg

SEQ ID NO: 8068 - DNA, 22 bp, Artificial Sequence
  Synthetic construct
ggtttgacatcgacaccacggt

SEQ ID NO: 8069 - DNA, 22 bp, Artificial Sequence
  Synthetic construct
gtttgacatcgacaccacggta

SEQ ID NO: 8070 - DNA, 22 bp, Artificial Sequence
  Synthetic construct
tttgacatcgacaccacggtaa

SEQ ID NO: 8071 - DNA, 22 bp, Artificial Sequence
  Synthetic construct
ttgacatcgacaccacggtaaa

SEQ ID NO: 8072 - DNA, 22 bp, Artificial Sequence
  Synthetic construct
tgacatcgacaccacggtaaaa

SEQ ID NO: 8073 - DNA, 22 bp, Artificial Sequence
  Synthetic construct
gacatcgacaccacggtaaaag

SEQ ID NO: 8074 - DNA, 22 bp, Artificial Sequence
  Synthetic construct
acatcgacaccacggtaaaagt

SEQ ID NO: 8075 - DNA, 22 bp, Artificial Sequence
  Synthetic construct
catcgacaccacggtaaaagtg

SEQ ID NO: 8076 - DNA, 22 bp, Artificial Sequence
  Synthetic construct
atcgacaccacggtaaaagtgc

SEQ ID NO: 8077 - DNA, 22 bp, Artificial Sequence
  Synthetic construct
tcgacaccacggtaaaagtgcg

SEQ ID NO: 8078 - DNA, 22 bp, Artificial Sequence
  Synthetic construct
cgacaccacggtaaaagtgcgc

SEQ ID NO: 8079 - DNA, 22 bp, Artificial Sequence
  Synthetic construct
gacaccacggtaaaagtgcgcg

SEQ ID NO: 8080 - DNA, 22 bp, Artificial Sequence
  Synthetic construct
acaccacggtaaaagtgcgcgc

SEQ ID NO: 8081 - DNA, 22 bp, Artificial Sequence
  Synthetic construct
caccacggtaaaagtgcgcgcc

SEQ ID NO: 8082 - DNA, 22 bp, Artificial Sequence
  Synthetic construct
accacggtaaaagtgcgcgccg

SEQ ID NO: 8083 - DNA, 22 bp, Artificial Sequence
  Synthetic construct
ccacggtaaaagtgcgcgccgc

SEQ ID NO: 8084 - DNA, 22 bp, Artificial Sequence
  Synthetic construct
cacggtaaaagtgcgcgccgca

SEQ ID NO: 8085 - DNA, 22 bp, Artificial Sequence
  Synthetic construct
acggtaaaagtgcgcgccgcag

SEQ ID NO: 8086 - DNA, 22 bp, Artificial Sequence
  Synthetic construct
cggtaaaagtgcgcgccgcagc

SEQ ID NO: 8087 - DNA, 22 bp, Artificial Sequence
  Synthetic construct
ggtaaaagtgcgcgccgcagct

SEQ ID NO: 8088 - DNA, 22 bp, Artificial Sequence
  Synthetic construct
gtaaaagtgcgcgccgcagctc

SEQ ID NO: 8089 - DNA, 22 bp, Artificial Sequence
  Synthetic construct
taaaagtgcgcgccgcagctct

SEQ ID NO: 8090 - DNA, 22 bp, Artificial Sequence
  Synthetic construct
aaaagtgcgcgccgcagctctc

SEQ ID NO: 8091 - DNA, 22 bp, Artificial Sequence
  Synthetic construct
aaagtgcgcgccgcagctctcg

SEQ ID NO: 8092 - DNA, 22 bp, Artificial Sequence
  Synthetic construct
aagtgcgcgccgcagctctcgc

SEQ ID NO: 8093 - DNA, 22 bp, Artificial Sequence
  Synthetic construct
agtgcgcgccgcagctctcgcg

SEQ ID NO: 8094 - DNA, 22 bp, Artificial Sequence
  Synthetic construct
gtgcgcgccgcagctctcgcga

SEQ ID NO: 8095 - DNA, 22 bp, Artificial Sequence
  Synthetic construct
tgcgcgccgcagctctcgcgaa

SEQ ID NO: 8096 - DNA, 22 bp, Artificial Sequence
  Synthetic construct
gcgcgccgcagctctcgcgaaa

SEQ ID NO: 8097 - DNA, 22 bp, Artificial Sequence
  Synthetic construct
cgcgccgcagctctcgcgaaag

SEQ ID NO: 8098 - DNA, 22 bp, Artificial Sequence
  Synthetic construct
gcgccgcagctctcgcgaaaga

SEQ ID NO: 8099 - DNA, 22 bp, Artificial Sequence
  Synthetic construct
cgccgcagctctcgcgaaagag

SEQ ID NO: 8100 - DNA, 22 bp, Artificial Sequence
  Synthetic construct
gccgcagctctcgcgaaagagc

SEQ ID NO: 8101 - DNA, 22 bp, Artificial Sequence
  Synthetic construct
ccgcagctctcgcgaaagagcc

SEQ ID NO: 8102 - DNA, 22 bp, Artificial Sequence
  Synthetic construct
cgcagctctcgcgaaagagccc

SEQ ID NO: 8103 - DNA, 22 bp, Artificial Sequence
  Synthetic construct
gcagctctcgcgaaagagcccg

SEQ ID NO: 8104 - DNA, 22 bp, Artificial Sequence
  Synthetic construct
cagctctcgcgaaagagcccgg

SEQ ID NO: 8105 - DNA, 22 bp, Artificial Sequence
  Synthetic construct
agctctcgcgaaagagcccgga

SEQ ID NO: 8106 - DNA, 22 bp, Artificial Sequence
  Synthetic construct
gctctcgcgaaagagcccggac

SEQ ID NO: 8107 - DNA, 22 bp, Artificial Sequence
  Synthetic construct
ctctcgcgaaagagcccggaca

SEQ ID NO: 8108 - DNA, 22 bp, Artificial Sequence
  Synthetic construct
tctcgcgaaagagcccggacac

SEQ ID NO: 8109 - DNA, 22 bp, Artificial Sequence
  Synthetic construct
ctcgcgaaagagcccggacacg

SEQ ID NO: 8110 - DNA, 22 bp, Artificial Sequence
  Synthetic construct
tcgcgaaagagcccggacacga

SEQ ID NO: 8111 - DNA, 22 bp, Artificial Sequence
  Synthetic construct
cgcgaaagagcccggacacgaa

SEQ ID NO: 8112 - DNA, 22 bp, Artificial Sequence
  Synthetic construct
gcgaaagagcccggacacgaac

SEQ ID NO: 8113 - DNA, 22 bp, Artificial Sequence
  Synthetic construct
cgaaagagcccggacacgaacg

SEQ ID NO: 8114 - DNA, 22 bp, Artificial Sequence
  Synthetic construct
gaaagagcccggacacgaacgt

SEQ ID NO: 8115 - DNA, 22 bp, Artificial Sequence
  Synthetic construct
aaagagcccggacacgaacgtt

SEQ ID NO: 8116 - DNA, 22 bp, Artificial Sequence
  Synthetic construct
aagagcccggacacgaacgttt

SEQ ID NO: 8117 - DNA, 22 bp, Artificial Sequence
  Synthetic construct
agagcccggacacgaacgtttt

SEQ ID NO: 8118 - DNA, 22 bp, Artificial Sequence
  Synthetic construct
gagcccggacacgaacgtttta

SEQ ID NO: 8119 - DNA, 22 bp, Artificial Sequence
  Synthetic construct
agcccggacacgaacgttttac

SEQ ID NO: 8120 - DNA, 22 bp, Artificial Sequence
  Synthetic construct
gcccggacacgaacgttttacg

SEQ ID NO: 8121 - DNA, 22 bp, Artificial Sequence
  Synthetic construct
cccggacacgaacgttttacga

SEQ ID NO: 8122 - DNA, 22 bp, Artificial Sequence
  Synthetic construct
ccggacacgaacgttttacgaa

SEQ ID NO: 8123 - DNA, 22 bp, Artificial Sequence
  Synthetic construct
cggacacgaacgttttacgaag

SEQ ID NO: 8124 - DNA, 22 bp, Artificial Sequence
  Synthetic construct
ggacacgaacgttttacgaaga

SEQ ID NO: 8125 - DNA, 22 bp, Artificial Sequence
  Synthetic construct
gacacgaacgttttacgaagat

SEQ ID NO: 8126 - DNA, 22 bp, Artificial Sequence
  Synthetic construct
acacgaacgttttacgaagatt

SEQ ID NO: 8127 - DNA, 22 bp, Artificial Sequence
  Synthetic construct
cacgaacgttttacgaagattc

SEQ ID NO: 8128 - DNA, 22 bp, Artificial Sequence
  Synthetic construct
acgaacgttttacgaagattcg

SEQ ID NO: 8129 - DNA, 22 bp, Artificial Sequence
  Synthetic construct
cgaacgttttacgaagattcgg

SEQ ID NO: 8130 - DNA, 22 bp, Artificial Sequence
  Synthetic construct
gaacgttttacgaagattcggt

SEQ ID NO: 8131 - DNA, 22 bp, Artificial Sequence
  Synthetic construct
aacgttttacgaagattcggtt

SEQ ID NO: 8132 - DNA, 22 bp, Artificial Sequence
  Synthetic construct
acgttttacgaagattcggttt

SEQ ID NO: 8133 - DNA, 22 bp, Artificial Sequence
  Synthetic construct
cgttttacgaagattcggttta

SEQ ID NO: 8134 - DNA, 22 bp, Artificial Sequence
  Synthetic construct
gttttacgaagattcggtttaa

SEQ ID NO: 8135 - DNA, 22 bp, Artificial Sequence
  Synthetic construct
ttttacgaagattcggtttaaa

SEQ ID NO: 8136 - DNA, 22 bp, Artificial Sequence
  Synthetic construct
tttacgaagattcggtttaaaa

SEQ ID NO: 8137 - DNA, 22 bp, Artificial Sequence
  Synthetic construct
ttacgaagattcggtttaaaac

SEQ ID NO: 8138 - DNA, 22 bp, Artificial Sequence
  Synthetic construct
tacgaagattcggtttaaaacc

SEQ ID NO: 8139 - DNA, 22 bp, Artificial Sequence
  Synthetic construct
acgaagattcggtttaaaaccg

SEQ ID NO: 8140 - DNA, 22 bp, Artificial Sequence
  Synthetic construct
cgaagattcggtttaaaaccgt

SEQ ID NO: 8141 - DNA, 22 bp, Artificial Sequence
  Synthetic construct
gaagattcggtttaaaaccgta

SEQ ID NO: 8142 - DNA, 22 bp, Artificial Sequence
  Synthetic construct
aagattcggtttaaaaccgtag

SEQ ID NO: 8143 - DNA, 22 bp, Artificial Sequence
  Synthetic construct
agattcggtttaaaaccgtagt

SEQ ID NO: 8144 - DNA, 22 bp, Artificial Sequence
  Synthetic construct
gattcggtttaaaaccgtagta

SEQ ID NO: 8145 - DNA, 22 bp, Artificial Sequence
  Synthetic construct
attcggtttaaaaccgtagtag

SEQ ID NO: 8146 - DNA, 22 bp, Artificial Sequence
  Synthetic construct
ttcggtttaaaaccgtagtagg

SEQ ID NO: 8147 - DNA, 22 bp, Artificial Sequence
  Synthetic construct
tcggtttaaaaccgtagtaggc

SEQ ID NO: 8148 - DNA, 22 bp, Artificial Sequence
  Synthetic construct
cggtttaaaaccgtagtaggca

SEQ ID NO: 8149 - DNA, 22 bp, Artificial Sequence
  Synthetic construct
ggtttaaaaccgtagtaggcaa

SEQ ID NO: 8150 - DNA, 22 bp, Artificial Sequence
  Synthetic construct
gtttaaaaccgtagtaggcaag

SEQ ID NO: 8151 - DNA, 22 bp, Artificial Sequence
  Synthetic construct
tttaaaaccgtagtaggcaagt

SEQ ID NO: 8152 - DNA, 22 bp, Artificial Sequence
  Synthetic construct
ttaaaaccgtagtaggcaagtg

SEQ ID NO: 8153 - DNA, 22 bp, Artificial Sequence
  Synthetic construct
taaaaccgtagtaggcaagtgc

SEQ ID NO: 8154 - DNA, 22 bp, Artificial Sequence
  Synthetic construct
aaaaccgtagtaggcaagtgcc

SEQ ID NO: 8155 - DNA, 22 bp, Artificial Sequence
  Synthetic construct
aaaccgtagtaggcaagtgcct

SEQ ID NO: 8156 - DNA, 22 bp, Artificial Sequence
  Synthetic construct
aaccgtagtaggcaagtgcctc

SEQ ID NO: 8157 - DNA, 22 bp, Artificial Sequence
  Synthetic construct
accgtagtaggcaagtgcctct

SEQ ID NO: 8158 - DNA, 22 bp, Artificial Sequence
  Synthetic construct
ccgtagtaggcaagtgcctcta

SEQ ID NO: 8159 - DNA, 22 bp, Artificial Sequence
  Synthetic construct
cgtagtaggcaagtgcctctag

SEQ ID NO: 8160 - DNA, 22 bp, Artificial Sequence
  Synthetic construct
gtagtaggcaagtgcctctagc

SEQ ID NO: 8161 - DNA, 22 bp, Artificial Sequence
  Synthetic construct
tagtaggcaagtgcctctagca

SEQ ID NO: 8162 - DNA, 22 bp, Artificial Sequence
  Synthetic construct
agtaggcaagtgcctctagcac

SEQ ID NO: 8163 - DNA, 22 bp, Artificial Sequence
  Synthetic construct
gtaggcaagtgcctctagcaca

SEQ ID NO: 8164 - DNA, 22 bp, Artificial Sequence
  Synthetic construct
taggcaagtgcctctagcacac

SEQ ID NO: 8165 - DNA, 22 bp, Artificial Sequence
  Synthetic construct
aggcaagtgcctctagcacacg

SEQ ID NO: 8166 - DNA, 22 bp, Artificial Sequence
  Synthetic construct
ggcaagtgcctctagcacacgg

SEQ ID NO: 8167 - DNA, 22 bp, Artificial Sequence
  Synthetic construct
gcaagtgcctctagcacacggg

SEQ ID NO: 8168 - DNA, 22 bp, Artificial Sequence
  Synthetic construct
caagtgcctctagcacacgggg

SEQ ID NO: 8169 - DNA, 22 bp, Artificial Sequence
  Synthetic construct
aagtgcctctagcacacggggt

SEQ ID NO: 8170 - DNA, 22 bp, Artificial Sequence
  Synthetic construct
agtgcctctagcacacggggtg

SEQ ID NO: 8171 - DNA, 22 bp, Artificial Sequence
  Synthetic construct
gtgcctctagcacacggggtgc

SEQ ID NO: 8172 - DNA, 22 bp, Artificial Sequence
  Synthetic construct
tgcctctagcacacggggtgca

SEQ ID NO: 8173 - DNA, 22 bp, Artificial Sequence
  Synthetic construct
gcctctagcacacggggtgcaa

SEQ ID NO: 8174 - DNA, 22 bp, Artificial Sequence
  Synthetic construct
cctctagcacacggggtgcaat

SEQ ID NO: 8175 - DNA, 22 bp, Artificial Sequence
  Synthetic construct
ctctagcacacggggtgcaatc

SEQ ID NO: 8176 - DNA, 22 bp, Artificial Sequence
  Synthetic construct
tctagcacacggggtgcaatct

SEQ ID NO: 8177 - DNA, 22 bp, Artificial Sequence
  Synthetic construct
ctagcacacggggtgcaatctc

SEQ ID NO: 8178 - DNA, 22 bp, Artificial Sequence
  Synthetic construct
tagcacacggggtgcaatctca

SEQ ID NO: 8179 - DNA, 22 bp, Artificial Sequence
  Synthetic construct
agcacacggggtgcaatctcac

SEQ ID NO: 8180 - DNA, 22 bp, Artificial Sequence
  Synthetic construct
gcacacggggtgcaatctcact

SEQ ID NO: 8181 - DNA, 22 bp, Artificial Sequence
  Synthetic construct
cacacggggtgcaatctcactg

SEQ ID NO: 8182 - DNA, 22 bp, Artificial Sequence
  Synthetic construct
acacggggtgcaatctcactgg

SEQ ID NO: 8183 - DNA, 22 bp, Artificial Sequence
  Synthetic construct
cacggggtgcaatctcactggg

SEQ ID NO: 8184 - DNA, 22 bp, Artificial Sequence
  Synthetic construct
acggggtgcaatctcactggga

SEQ ID NO: 8185 - DNA, 22 bp, Artificial Sequence
  Synthetic construct
cggggtgcaatctcactgggac

SEQ ID NO: 8186 - DNA, 22 bp, Artificial Sequence
  Synthetic construct
ggggtgcaatctcactgggaca

SEQ ID NO: 8187 - DNA, 22 bp, Artificial Sequence
  Synthetic construct
gggtgcaatctcactgggacat

SEQ ID NO: 8188 - DNA, 22 bp, Artificial Sequence
  Synthetic construct
ggtgcaatctcactgggacata

SEQ ID NO: 8189 - DNA, 22 bp, Artificial Sequence
  Synthetic construct
gtgcaatctcactgggacatat

SEQ ID NO: 8190 - DNA, 22 bp, Artificial Sequence
  Synthetic construct
tgcaatctcactgggacatata

SEQ ID NO: 8191 - DNA, 22 bp, Artificial Sequence
  Synthetic construct
gcaatctcactgggacatataa

SEQ ID NO: 8192 - DNA, 22 bp, Artificial Sequence
  Synthetic construct
caatctcactgggacatataat

SEQ ID NO: 8193 - DNA, 22 bp, Artificial Sequence
  Synthetic construct
aatctcactgggacatataata

SEQ ID NO: 8194 - DNA, 22 bp, Artificial Sequence
  Synthetic construct
atctcactgggacatataatat

SEQ ID NO: 8195 - DNA, 22 bp, Artificial Sequence
  Synthetic construct
tctcactgggacatataatatc

SEQ ID NO: 8196 - DNA, 22 bp, Artificial Sequence
  Synthetic construct
ctcactgggacatataatatcg

SEQ ID NO: 8197 - DNA, 22 bp, Artificial Sequence
  Synthetic construct
tcactgggacatataatatcgt

SEQ ID NO: 8198 - DNA, 22 bp, Artificial Sequence
  Synthetic construct
cactgggacatataatatcgtc

SEQ ID NO: 8199 - DNA, 22 bp, Artificial Sequence
  Synthetic construct
actgggacatataatatcgtcc

SEQ ID NO: 8200 - DNA, 22 bp, Artificial Sequence
  Synthetic construct
ctgggacatataatatcgtccc

SEQ ID NO: 8201 - DNA, 22 bp, Artificial Sequence
  Synthetic construct
tgggacatataatatcgtcccc

SEQ ID NO: 8202 - DNA, 22 bp, Artificial Sequence
  Synthetic construct
gggacatataatatcgtccccg

SEQ ID NO: 8203 - DNA, 22 bp, Artificial Sequence
  Synthetic construct
ggacatataatatcgtccccgt

SEQ ID NO: 8204 - DNA, 22 bp, Artificial Sequence
  Synthetic construct
gacatataatatcgtccccgta

SEQ ID NO: 8205 - DNA, 22 bp, Artificial Sequence
  Synthetic construct
acatataatatcgtccccgtag

SEQ ID NO: 8206 - DNA, 22 bp, Artificial Sequence
  Synthetic construct
catataatatcgtccccgtaga

SEQ ID NO: 8207 - DNA, 22 bp, Artificial Sequence
  Synthetic construct
atataatatcgtccccgtagat

SEQ ID NO: 8208 - DNA, 22 bp, Artificial Sequence
  Synthetic construct
tataatatcgtccccgtagatg

SEQ ID NO: 8209 - DNA, 22 bp, Artificial Sequence
  Synthetic construct
ataatatcgtccccgtagatgc

SEQ ID NO: 8210 - DNA, 22 bp, Artificial Sequence
  Synthetic construct
taatatcgtccccgtagatgcc

SEQ ID NO: 8211 - DNA, 22 bp, Artificial Sequence
  Synthetic construct
aatatcgtccccgtagatgcct

SEQ ID NO: 8212 - DNA, 22 bp, Artificial Sequence
  Synthetic construct
atatcgtccccgtagatgccta

SEQ ID NO: 8213 - DNA, 22 bp, Artificial Sequence
  Synthetic construct
tatcgtccccgtagatgcctat

SEQ ID NO: 8214 - DNA, 22 bp, Artificial Sequence
  Synthetic construct
atcgtccccgtagatgcctatg

SEQ ID NO: 8215 - DNA, 22 bp, Artificial Sequence
  Synthetic construct
tcgtccccgtagatgcctatgg

SEQ ID NO: 8216 - DNA, 22 bp, Artificial Sequence
  Synthetic construct
cgtccccgtagatgcctatggt

SEQ ID NO: 8217 - DNA, 22 bp, Artificial Sequence
  Synthetic construct
gtccccgtagatgcctatggtt

SEQ ID NO: 8218 - DNA, 22 bp, Artificial Sequence
  Synthetic construct
tccccgtagatgcctatggttc

SEQ ID NO: 8219 - DNA, 22 bp, Artificial Sequence
  Synthetic construct
ccccgtagatgcctatggttcc

SEQ ID NO: 8220 - DNA, 22 bp, Artificial Sequence
  Synthetic construct
cccgtagatgcctatggttccg

SEQ ID NO: 8221 - DNA, 22 bp, Artificial Sequence
  Synthetic construct
ccgtagatgcctatggttccgg

SEQ ID NO: 8222 - DNA, 22 bp, Artificial Sequence
  Synthetic construct
cgtagatgcctatggttccggc

SEQ ID NO: 8223 - DNA, 22 bp, Artificial Sequence
  Synthetic construct
gtagatgcctatggttccggcg

SEQ ID NO: 8224 - DNA, 22 bp, Artificial Sequence
  Synthetic construct
tagatgcctatggttccggcgt

SEQ ID NO: 8225 - DNA, 22 bp, Artificial Sequence
  Synthetic construct
agatgcctatggttccggcgtt

SEQ ID NO: 8226 - DNA, 22 bp, Artificial Sequence
  Synthetic construct
gatgcctatggttccggcgtta

SEQ ID NO: 8227 - DNA, 22 bp, Artificial Sequence
  Synthetic construct
atgcctatggttccggcgttac

SEQ ID NO: 8228 - DNA, 22 bp, Artificial Sequence
  Synthetic construct
tgcctatggttccggcgttacc

SEQ ID NO: 8229 - DNA, 22 bp, Artificial Sequence
  Synthetic construct
gcctatggttccggcgttacca

SEQ ID NO: 8230 - DNA, 22 bp, Artificial Sequence
  Synthetic construct
cctatggttccggcgttaccaa

SEQ ID NO: 8231 - DNA, 22 bp, Artificial Sequence
  Synthetic construct
ctatggttccggcgttaccaaa

SEQ ID NO: 8232 - DNA, 22 bp, Artificial Sequence
  Synthetic construct
tatggttccggcgttaccaaaa

SEQ ID NO: 8233 - DNA, 22 bp, Artificial Sequence
  Synthetic construct
atggttccggcgttaccaaaat

SEQ ID NO: 8234 - DNA, 22 bp, Artificial Sequence
  Synthetic construct
tggttccggcgttaccaaaatg

SEQ ID NO: 8235 - DNA, 22 bp, Artificial Sequence
  Synthetic construct
ggttccggcgttaccaaaatgg

SEQ ID NO: 8236 - DNA, 22 bp, Artificial Sequence
  Synthetic construct
gttccggcgttaccaaaatgga

SEQ ID NO: 8237 - DNA, 22 bp, Artificial Sequence
  Synthetic construct
ttccggcgttaccaaaatggat

SEQ ID NO: 8238 - DNA, 22 bp, Artificial Sequence
  Synthetic construct
tccggcgttaccaaaatggatt

SEQ ID NO: 8239 - DNA, 22 bp, Artificial Sequence
  Synthetic construct
ccggcgttaccaaaatggattt

SEQ ID NO: 8240 - DNA, 22 bp, Artificial Sequence
  Synthetic construct
cggcgttaccaaaatggatttg

SEQ ID NO: 8241 - DNA, 22 bp, Artificial Sequence
  Synthetic construct
ggcgttaccaaaatggatttgg

SEQ ID NO: 8242 - DNA, 22 bp, Artificial Sequence
  Synthetic construct
gcgttaccaaaatggatttggg

SEQ ID NO: 8243 - DNA, 22 bp, Artificial Sequence
  Synthetic construct
cgttaccaaaatggatttgggt

SEQ ID NO: 8244 - DNA, 22 bp, Artificial Sequence
  Synthetic construct
gttaccaaaatggatttgggtc

SEQ ID NO: 8245 - DNA, 22 bp, Artificial Sequence
  Synthetic construct
ttaccaaaatggatttgggtcg

SEQ ID NO: 8246 - DNA, 22 bp, Artificial Sequence
  Synthetic construct
taccaaaatggatttgggtcgc

SEQ ID NO: 8247 - DNA, 22 bp, Artificial Sequence
  Synthetic construct
accaaaatggatttgggtcgct

SEQ ID NO: 8248 - DNA, 22 bp, Artificial Sequence
  Synthetic construct
ccaaaatggatttgggtcgctt

SEQ ID NO: 8249 - DNA, 22 bp, Artificial Sequence
  Synthetic construct
caaaatggatttgggtcgcttt

SEQ ID NO: 8250 - DNA, 22 bp, Artificial Sequence
  Synthetic construct
aaaatggatttgggtcgctttg

SEQ ID NO: 8251 - DNA, 22 bp, Artificial Sequence
  Synthetic construct
aaatggatttgggtcgctttga

SEQ ID NO: 8252 - DNA, 22 bp, Artificial Sequence
  Synthetic construct
aatggatttgggtcgctttgac

SEQ ID NO: 8253 - DNA, 22 bp, Artificial Sequence
  Synthetic construct
atggatttgggtcgctttgact

SEQ ID NO: 8254 - DNA, 22 bp, Artificial Sequence
  Synthetic construct
tggatttgggtcgctttgacta

SEQ ID NO: 8255 - DNA, 22 bp, Artificial Sequence
  Synthetic construct
ggatttgggtcgctttgactat

SEQ ID NO: 8256 - DNA, 22 bp, Artificial Sequence
  Synthetic construct
gatttgggtcgctttgactatt

SEQ ID NO: 8257 - DNA, 22 bp, Artificial Sequence
  Synthetic construct
atttgggtcgctttgactattg

SEQ ID NO: 8258 - DNA, 22 bp, Artificial Sequence
  Synthetic construct
tttgggtcgctttgactattgc

SEQ ID NO: 8259 - DNA, 22 bp, Artificial Sequence
  Synthetic construct
ttgggtcgctttgactattgcc

SEQ ID NO: 8260 - DNA, 22 bp, Artificial Sequence
  Synthetic construct
tgggtcgctttgactattgccc

SEQ ID NO: 8261 - DNA, 22 bp, Artificial Sequence
  Synthetic construct
gggtcgctttgactattgccca

SEQ ID NO: 8262 - DNA, 22 bp, Artificial Sequence
  Synthetic construct
ggtcgctttgactattgcccag

SEQ ID NO: 8263 - DNA, 22 bp, Artificial Sequence
  Synthetic construct
gtcgctttgactattgcccaga

SEQ ID NO: 8264 - DNA, 22 bp, Artificial Sequence
  Synthetic construct
tcgctttgactattgcccagaa

SEQ ID NO: 8265 - DNA, 22 bp, Artificial Sequence
  Synthetic construct
cgctttgactattgcccagaat

SEQ ID NO: 8266 - DNA, 22 bp, Artificial Sequence
  Synthetic construct
gctttgactattgcccagaata

SEQ ID NO: 8267 - DNA, 22 bp, Artificial Sequence
  Synthetic construct
ctttgactattgcccagaatat

SEQ ID NO: 8268 - DNA, 22 bp, Artificial Sequence
  Synthetic construct
tttgactattgcccagaatatc

SEQ ID NO: 8269 - DNA, 22 bp, Artificial Sequence
  Synthetic construct
ttgactattgcccagaatatca

SEQ ID NO: 8270 - DNA, 22 bp, Artificial Sequence
  Synthetic construct
tgactattgcccagaatatcat

SEQ ID NO: 8271 - DNA, 22 bp, Artificial Sequence
  Synthetic construct
gactattgcccagaatatcatg

SEQ ID NO: 8272 - DNA, 22 bp, Artificial Sequence
  Synthetic construct
actattgcccagaatatcatgg

SEQ ID NO: 8273 - DNA, 22 bp, Artificial Sequence
  Synthetic construct
ctattgcccagaatatcatgga

SEQ ID NO: 8274 - DNA, 22 bp, Artificial Sequence
  Synthetic construct
tattgcccagaatatcatggac

SEQ ID NO: 8275 - DNA, 22 bp, Artificial Sequence
  Synthetic construct
attgcccagaatatcatggact

SEQ ID NO: 8276 - DNA, 22 bp, Artificial Sequence
  Synthetic construct
ttgcccagaatatcatggactc

SEQ ID NO: 8277 - DNA, 22 bp, Artificial Sequence
  Synthetic construct
tgcccagaatatcatggactct

SEQ ID NO: 8278 - DNA, 22 bp, Artificial Sequence
  Synthetic construct
gcccagaatatcatggactcta

SEQ ID NO: 8279 - DNA, 22 bp, Artificial Sequence
  Synthetic construct
cccagaatatcatggactctag

SEQ ID NO: 8280 - DNA, 22 bp, Artificial Sequence
  Synthetic construct
ccagaatatcatggactctagc

SEQ ID NO: 8281 - DNA, 22 bp, Artificial Sequence
  Synthetic construct
cagaatatcatggactctagct

SEQ ID NO: 8282 - DNA, 22 bp, Artificial Sequence
  Synthetic construct
agaatatcatggactctagctc

SEQ ID NO: 8283 - DNA, 22 bp, Artificial Sequence
  Synthetic construct
gaatatcatggactctagctca

SEQ ID NO: 8284 - DNA, 22 bp, Artificial Sequence
  Synthetic construct
aatatcatggactctagctcaa

SEQ ID NO: 8285 - DNA, 22 bp, Artificial Sequence
  Synthetic construct
atatcatggactctagctcaaa

SEQ ID NO: 8286 - DNA, 22 bp, Artificial Sequence
  Synthetic construct
tatcatggactctagctcaaat

SEQ ID NO: 8287 - DNA, 22 bp, Artificial Sequence
  Synthetic construct
atcatggactctagctcaaatg

SEQ ID NO: 8288 - DNA, 22 bp, Artificial Sequence
  Synthetic construct
tcatggactctagctcaaatgt

SEQ ID NO: 8289 - DNA, 22 bp, Artificial Sequence
  Synthetic construct
catggactctagctcaaatgtg

SEQ ID NO: 8290 - DNA, 22 bp, Artificial Sequence
  Synthetic construct
atggactctagctcaaatgtga

SEQ ID NO: 8291 - DNA, 22 bp, Artificial Sequence
  Synthetic construct
tggactctagctcaaatgtgaa

SEQ ID NO: 8292 - DNA, 22 bp, Artificial Sequence
  Synthetic construct
ggactctagctcaaatgtgaac

SEQ ID NO: 8293 - DNA, 22 bp, Artificial Sequence
  Synthetic construct
gactctagctcaaatgtgaacc

SEQ ID NO: 8294 - DNA, 22 bp, Artificial Sequence
  Synthetic construct
actctagctcaaatgtgaaccc

SEQ ID NO: 8295 - DNA, 22 bp, Artificial Sequence
  Synthetic construct
ctctagctcaaatgtgaaccca

SEQ ID NO: 8296 - DNA, 22 bp, Artificial Sequence
  Synthetic construct
tctagctcaaatgtgaacccat

SEQ ID NO: 8297 - DNA, 22 bp, Artificial Sequence
  Synthetic construct
ctagctcaaatgtgaacccatt

SEQ ID NO: 8298 - DNA, 22 bp, Artificial Sequence
  Synthetic construct
tagctcaaatgtgaacccattt

SEQ ID NO: 8299 - DNA, 22 bp, Artificial Sequence
  Synthetic construct
agctcaaatgtgaacccatttc

SEQ ID NO: 8300 - DNA, 22 bp, Artificial Sequence
  Synthetic construct
gctcaaatgtgaacccatttcc

SEQ ID NO: 8301 - DNA, 22 bp, Artificial Sequence
  Synthetic construct
ctcaaatgtgaacccatttccc

SEQ ID NO: 8302 - DNA, 22 bp, Artificial Sequence
  Synthetic construct
tcaaatgtgaacccatttccca

SEQ ID NO: 8303 - DNA, 22 bp, Artificial Sequence
  Synthetic construct
caaatgtgaacccatttcccat

SEQ ID NO: 8304 - DNA, 22 bp, Artificial Sequence
  Synthetic construct
aaatgtgaacccatttcccatt

SEQ ID NO: 8305 - DNA, 22 bp, Artificial Sequence
  Synthetic construct
aatgtgaacccatttcccattg

SEQ ID NO: 8306 - DNA, 22 bp, Artificial Sequence
  Synthetic construct
atgtgaacccatttcccattgt

SEQ ID NO: 8307 - DNA, 22 bp, Artificial Sequence
  Synthetic construct
tgtgaacccatttcccattgtg

SEQ ID NO: 8308 - DNA, 22 bp, Artificial Sequence
  Synthetic construct
gtgaacccatttcccattgtgg

SEQ ID NO: 8309 - DNA, 22 bp, Artificial Sequence
  Synthetic construct
tgaacccatttcccattgtgga

SEQ ID NO: 8310 - DNA, 22 bp, Artificial Sequence
  Synthetic construct
gaacccatttcccattgtggaa

SEQ ID NO: 8311 - DNA, 22 bp, Artificial Sequence
  Synthetic construct
aacccatttcccattgtggaaa

SEQ ID NO: 8312 - DNA, 22 bp, Artificial Sequence
  Synthetic construct
acccatttcccattgtggaaaa

SEQ ID NO: 8313 - DNA, 22 bp, Artificial Sequence
  Synthetic construct
cccatttcccattgtggaaaat

SEQ ID NO: 8314 - DNA, 22 bp, Artificial Sequence
  Synthetic construct
ccatttcccattgtggaaaata

SEQ ID NO: 8315 - DNA, 22 bp, Artificial Sequence
  Synthetic construct
catttcccattgtggaaaatag

SEQ ID NO: 8316 - DNA, 22 bp, Artificial Sequence
  Synthetic construct
atttcccattgtggaaaatagt

SEQ ID NO: 8317 - DNA, 22 bp, Artificial Sequence
  Synthetic construct
tttcccattgtggaaaatagtt

SEQ ID NO: 8318 - DNA, 22 bp, Artificial Sequence
  Synthetic construct
ttcccattgtggaaaatagttc

SEQ ID NO: 8319 - DNA, 22 bp, Artificial Sequence
  Synthetic construct
tcccattgtggaaaatagttcc

SEQ ID NO: 8320 - DNA, 22 bp, Artificial Sequence
  Synthetic construct
cccattgtggaaaatagttccc

SEQ ID NO: 8321 - DNA, 22 bp, Artificial Sequence
  Synthetic construct
ccattgtggaaaatagttccca

SEQ ID NO: 8322 - DNA, 22 bp, Artificial Sequence
  Synthetic construct
cattgtggaaaatagttcccat

SEQ ID NO: 8323 - DNA, 22 bp, Artificial Sequence
  Synthetic construct
attgtggaaaatagttcccatc

SEQ ID NO: 8324 - DNA, 22 bp, Artificial Sequence
  Synthetic construct
ttgtggaaaatagttcccatcg

SEQ ID NO: 8325 - DNA, 22 bp, Artificial Sequence
  Synthetic construct
tgtggaaaatagttcccatcgt

SEQ ID NO: 8326 - DNA, 22 bp, Artificial Sequence
  Synthetic construct
gtggaaaatagttcccatcgta

SEQ ID NO: 8327 - DNA, 22 bp, Artificial Sequence
  Synthetic construct
tggaaaatagttcccatcgtat

SEQ ID NO: 8328 - DNA, 22 bp, Artificial Sequence
  Synthetic construct
ggaaaatagttcccatcgtatc

SEQ ID NO: 8329 - DNA, 22 bp, Artificial Sequence
  Synthetic construct
gaaaatagttcccatcgtatcg

SEQ ID NO: 8330 - DNA, 22 bp, Artificial Sequence
  Synthetic construct
aaaatagttcccatcgtatcgt

SEQ ID NO: 8331 - DNA, 22 bp, Artificial Sequence
  Synthetic construct
aaatagttcccatcgtatcgtc

SEQ ID NO: 8332 - DNA, 22 bp, Artificial Sequence
  Synthetic construct
aatagttcccatcgtatcgtct

SEQ ID NO: 8333 - DNA, 22 bp, Artificial Sequence
  Synthetic construct
atagttcccatcgtatcgtctc

SEQ ID NO: 8334 - DNA, 22 bp, Artificial Sequence
  Synthetic construct
tagttcccatcgtatcgtctcg

SEQ ID NO: 8335 - DNA, 22 bp, Artificial Sequence
  Synthetic construct
agttcccatcgtatcgtctcgc

SEQ ID NO: 8336 - DNA, 22 bp, Artificial Sequence
  Synthetic construct
gttcccatcgtatcgtctcgcc

SEQ ID NO: 8337 - DNA, 22 bp, Artificial Sequence
  Synthetic construct
ttcccatcgtatcgtctcgcca

SEQ ID NO: 8338 - DNA, 22 bp, Artificial Sequence
  Synthetic construct
tcccatcgtatcgtctcgccat

SEQ ID NO: 8339 - DNA, 22 bp, Artificial Sequence
  Synthetic construct
cccatcgtatcgtctcgccatc

SEQ ID NO: 8340 - DNA, 22 bp, Artificial Sequence
  Synthetic construct
ccatcgtatcgtctcgccatct

SEQ ID NO: 8341 - DNA, 22 bp, Artificial Sequence
  Synthetic construct
catcgtatcgtctcgccatcta

SEQ ID NO: 8342 - DNA, 22 bp, Artificial Sequence
  Synthetic construct
atcgtatcgtctcgccatctac

SEQ ID NO: 8343 - DNA, 22 bp, Artificial Sequence
  Synthetic construct
tcgtatcgtctcgccatctacg

SEQ ID NO: 8344 - DNA, 22 bp, Artificial Sequence
  Synthetic construct
cgtatcgtctcgccatctacga

SEQ ID NO: 8345 - DNA, 22 bp, Artificial Sequence
  Synthetic construct
gtatcgtctcgccatctacgat

SEQ ID NO: 8346 - DNA, 22 bp, Artificial Sequence
  Synthetic construct
tatcgtctcgccatctacgatt

SEQ ID NO: 8347 - DNA, 22 bp, Artificial Sequence
  Synthetic construct
atcgtctcgccatctacgattc

SEQ ID NO: 8348 - DNA, 22 bp, Artificial Sequence
  Synthetic construct
tcgtctcgccatctacgattcc

SEQ ID NO: 8349 - DNA, 22 bp, Artificial Sequence
  Synthetic construct
cgtctcgccatctacgattccg

SEQ ID NO: 8350 - DNA, 22 bp, Artificial Sequence
  Synthetic construct
gtctcgccatctacgattccgt

SEQ ID NO: 8351 - DNA, 22 bp, Artificial Sequence
  Synthetic construct
tctcgccatctacgattccgta

SEQ ID NO: 8352 - DNA, 22 bp, Artificial Sequence
  Synthetic construct
ctcgccatctacgattccgtag

SEQ ID NO: 8353 - DNA, 22 bp, Artificial Sequence
  Synthetic construct
tcgccatctacgattccgtagt

SEQ ID NO: 8354 - DNA, 22 bp, Artificial Sequence
  Synthetic construct
cgccatctacgattccgtagtg

SEQ ID NO: 8355 - DNA, 22 bp, Artificial Sequence
  Synthetic construct
gccatctacgattccgtagtgt

SEQ ID NO: 8356 - DNA, 22 bp, Artificial Sequence
  Synthetic construct
ccatctacgattccgtagtgtg

SEQ ID NO: 8357 - DNA, 22 bp, Artificial Sequence
  Synthetic construct
catctacgattccgtagtgtga

SEQ ID NO: 8358 - DNA, 22 bp, Artificial Sequence
  Synthetic construct
atctacgattccgtagtgtgag

SEQ ID NO: 8359 - DNA, 22 bp, Artificial Sequence
  Synthetic construct
tctacgattccgtagtgtgagc

SEQ ID NO: 8360 - DNA, 22 bp, Artificial Sequence
  Synthetic construct
ctacgattccgtagtgtgagcg

SEQ ID NO: 8361 - DNA, 22 bp, Artificial Sequence
  Synthetic construct
tacgattccgtagtgtgagcgg

SEQ ID NO: 8362 - DNA, 22 bp, Artificial Sequence
  Synthetic construct
acgattccgtagtgtgagcgga

SEQ ID NO: 8363 - DNA, 22 bp, Artificial Sequence
  Synthetic construct
cgattccgtagtgtgagcggat

SEQ ID NO: 8364 - DNA, 22 bp, Artificial Sequence
  Synthetic construct
gattccgtagtgtgagcggata

SEQ ID NO: 8365 - DNA, 22 bp, Artificial Sequence
  Synthetic construct
attccgtagtgtgagcggatac

SEQ ID NO: 8366 - DNA, 22 bp, Artificial Sequence
  Synthetic construct
ttccgtagtgtgagcggatacg

SEQ ID NO: 8367 - DNA, 22 bp, Artificial Sequence
  Synthetic construct
tccgtagtgtgagcggatacga

SEQ ID NO: 8368 - DNA, 22 bp, Artificial Sequence
  Synthetic construct
ccgtagtgtgagcggatacgat

SEQ ID NO: 8369 - DNA, 22 bp, Artificial Sequence
  Synthetic construct
cgtagtgtgagcggatacgatc

SEQ ID NO: 8370 - DNA, 22 bp, Artificial Sequence
  Synthetic construct
gtagtgtgagcggatacgatcg

SEQ ID NO: 8371 - DNA, 22 bp, Artificial Sequence
  Synthetic construct
tagtgtgagcggatacgatcga

SEQ ID NO: 8372 - DNA, 22 bp, Artificial Sequence
  Synthetic construct
agtgtgagcggatacgatcgag

SEQ ID NO: 8373 - DNA, 22 bp, Artificial Sequence
  Synthetic construct
gtgtgagcggatacgatcgaga

SEQ ID NO: 8374 - DNA, 22 bp, Artificial Sequence
  Synthetic construct
tgtgagcggatacgatcgagat

SEQ ID NO: 8375 - DNA, 22 bp, Artificial Sequence
  Synthetic construct
gtgagcggatacgatcgagata

SEQ ID NO: 8376 - DNA, 22 bp, Artificial Sequence
  Synthetic construct
tgagcggatacgatcgagatat

SEQ ID NO: 8377 - DNA, 22 bp, Artificial Sequence
  Synthetic construct
gagcggatacgatcgagatatg

SEQ ID NO: 8378 - DNA, 22 bp, Artificial Sequence
  Synthetic construct
agcggatacgatcgagatatga

SEQ ID NO: 8379 - DNA, 22 bp, Artificial Sequence
  Synthetic construct
gcggatacgatcgagatatgaa

SEQ ID NO: 8380 - DNA, 22 bp, Artificial Sequence
  Synthetic construct
cggatacgatcgagatatgaat

SEQ ID NO: 8381 - DNA, 22 bp, Artificial Sequence
  Synthetic construct
ggatacgatcgagatatgaata

SEQ ID NO: 8382 - DNA, 22 bp, Artificial Sequence
  Synthetic construct
gatacgatcgagatatgaatat

SEQ ID NO: 8383 - DNA, 22 bp, Artificial Sequence
  Synthetic construct
atacgatcgagatatgaatata

SEQ ID NO: 8384 - DNA, 22 bp, Artificial Sequence
  Synthetic construct
tacgatcgagatatgaatatag

SEQ ID NO: 8385 - DNA, 22 bp, Artificial Sequence
  Synthetic construct
acgatcgagatatgaatatagc

SEQ ID NO: 8386 - DNA, 22 bp, Artificial Sequence
  Synthetic construct
cgatcgagatatgaatatagct

SEQ ID NO: 8387 - DNA, 22 bp, Artificial Sequence
  Synthetic construct
gatcgagatatgaatatagctc

SEQ ID NO: 8388 - DNA, 22 bp, Artificial Sequence
  Synthetic construct
atcgagatatgaatatagctct

SEQ ID NO: 8389 - DNA, 22 bp, Artificial Sequence
  Synthetic construct
tcgagatatgaatatagctctg

SEQ ID NO: 8390 - DNA, 22 bp, Artificial Sequence
  Synthetic construct
cgagatatgaatatagctctgg

SEQ ID NO: 8391 - DNA, 22 bp, Artificial Sequence
  Synthetic construct
gagatatgaatatagctctggt

SEQ ID NO: 8392 - DNA, 22 bp, Artificial Sequence
  Synthetic construct
agatatgaatatagctctggtg

SEQ ID NO: 8393 - DNA, 22 bp, Artificial Sequence
  Synthetic construct
gatatgaatatagctctggtgg

SEQ ID NO: 8394 - DNA, 22 bp, Artificial Sequence
  Synthetic construct
atatgaatatagctctggtggg

SEQ ID NO: 8395 - DNA, 22 bp, Artificial Sequence
  Synthetic construct
tatgaatatagctctggtggga

SEQ ID NO: 8396 - DNA, 22 bp, Artificial Sequence
  Synthetic construct
atgaatatagctctggtgggag

SEQ ID NO: 8397 - DNA, 22 bp, Artificial Sequence
  Synthetic construct
tgaatatagctctggtgggaga

SEQ ID NO: 8398 - DNA, 22 bp, Artificial Sequence
  Synthetic construct
gaatatagctctggtgggagaa

SEQ ID NO: 8399 - DNA, 22 bp, Artificial Sequence
  Synthetic construct
aatatagctctggtgggagaaa

SEQ ID NO: 8400 - DNA, 22 bp, Artificial Sequence
  Synthetic construct
atatagctctggtgggagaaaa

SEQ ID NO: 8401 - DNA, 22 bp, Artificial Sequence
  Synthetic construct
tatagctctggtgggagaaaac

SEQ ID NO: 8402 - DNA, 22 bp, Artificial Sequence
  Synthetic construct
atagctctggtgggagaaaact

SEQ ID NO: 8403 - DNA, 22 bp, Artificial Sequence
  Synthetic construct
tagctctggtgggagaaaactc

SEQ ID NO: 8404 - DNA, 22 bp, Artificial Sequence
  Synthetic construct
agctctggtgggagaaaactcc

SEQ ID NO: 8405 - DNA, 22 bp, Artificial Sequence
  Synthetic construct
gctctggtgggagaaaactcca

SEQ ID NO: 8406 - DNA, 22 bp, Artificial Sequence
  Synthetic construct
ctctggtgggagaaaactccac

SEQ ID NO: 8407 - DNA, 22 bp, Artificial Sequence
  Synthetic construct
tctggtgggagaaaactccaca

SEQ ID NO: 8408 - DNA, 22 bp, Artificial Sequence
  Synthetic construct
ctggtgggagaaaactccacac

SEQ ID NO: 8409 - DNA, 22 bp, Artificial Sequence
  Synthetic construct
tggtgggagaaaactccacacc

SEQ ID NO: 8410 - DNA, 22 bp, Artificial Sequence
  Synthetic construct
ggtgggagaaaactccacacca

SEQ ID NO: 8411 - DNA, 22 bp, Artificial Sequence
  Synthetic construct
gtgggagaaaactccacaccag

SEQ ID NO: 8412 - DNA, 22 bp, Artificial Sequence
  Synthetic construct
tgggagaaaactccacaccagg

SEQ ID NO: 8413 - DNA, 22 bp, Artificial Sequence
  Synthetic construct
gggagaaaactccacaccaggc

SEQ ID NO: 8414 - DNA, 22 bp, Artificial Sequence
  Synthetic construct
ggagaaaactccacaccaggcg

SEQ ID NO: 8415 - DNA, 22 bp, Artificial Sequence
  Synthetic construct
gagaaaactccacaccaggcga

SEQ ID NO: 8416 - DNA, 22 bp, Artificial Sequence
  Synthetic construct
agaaaactccacaccaggcgat

SEQ ID NO: 8417 - DNA, 22 bp, Artificial Sequence
  Synthetic construct
gaaaactccacaccaggcgatc

SEQ ID NO: 8418 - DNA, 22 bp, Artificial Sequence
  Synthetic construct
aaaactccacaccaggcgatcg

SEQ ID NO: 8419 - DNA, 22 bp, Artificial Sequence
  Synthetic construct
aaactccacaccaggcgatcgg

SEQ ID NO: 8420 - DNA, 22 bp, Artificial Sequence
  Synthetic construct
aactccacaccaggcgatcgga

SEQ ID NO: 8421 - DNA, 22 bp, Artificial Sequence
  Synthetic construct
actccacaccaggcgatcggag

SEQ ID NO: 8422 - DNA, 22 bp, Artificial Sequence
  Synthetic construct
ctccacaccaggcgatcggaga

SEQ ID NO: 8423 - DNA, 22 bp, Artificial Sequence
  Synthetic construct
tccacaccaggcgatcggagat

SEQ ID NO: 8424 - DNA, 22 bp, Artificial Sequence
  Synthetic construct
ccacaccaggcgatcggagatg

SEQ ID NO: 8425 - DNA, 22 bp, Artificial Sequence
  Synthetic construct
cacaccaggcgatcggagatgg

SEQ ID NO: 8426 - DNA, 22 bp, Artificial Sequence
  Synthetic construct
acaccaggcgatcggagatgga

SEQ ID NO: 8427 - DNA, 22 bp, Artificial Sequence
  Synthetic construct
caccaggcgatcggagatggaa

SEQ ID NO: 8428 - DNA, 22 bp, Artificial Sequence
  Synthetic construct
accaggcgatcggagatggaat

SEQ ID NO: 8429 - DNA, 22 bp, Artificial Sequence
  Synthetic construct
ccaggcgatcggagatggaatc

SEQ ID NO: 8430 - DNA, 22 bp, Artificial Sequence
  Synthetic construct
caggcgatcggagatggaatcg

SEQ ID NO: 8431 - DNA, 22 bp, Artificial Sequence
  Synthetic construct
aggcgatcggagatggaatcgg

SEQ ID NO: 8432 - DNA, 22 bp, Artificial Sequence
  Synthetic construct
ggcgatcggagatggaatcgga

SEQ ID NO: 8433 - DNA, 22 bp, Artificial Sequence
  Synthetic construct
gcgatcggagatggaatcggat

SEQ ID NO: 8434 - DNA, 22 bp, Artificial Sequence
  Synthetic construct
cgatcggagatggaatcggatg

SEQ ID NO: 8435 - DNA, 22 bp, Artificial Sequence
  Synthetic construct
gatcggagatggaatcggatgc

SEQ ID NO: 8436 - DNA, 22 bp, Artificial Sequence
  Synthetic construct
atcggagatggaatcggatgca

SEQ ID NO: 8437 - DNA, 22 bp, Artificial Sequence
  Synthetic construct
tcggagatggaatcggatgcag

SEQ ID NO: 8438 - DNA, 22 bp, Artificial Sequence
  Synthetic construct
cggagatggaatcggatgcaga

SEQ ID NO: 8439 - DNA, 22 bp, Artificial Sequence
  Synthetic construct
ggagatggaatcggatgcagac

SEQ ID NO: 8440 - DNA, 22 bp, Artificial Sequence
  Synthetic construct
gagatggaatcggatgcagacg

SEQ ID NO: 8441 - DNA, 22 bp, Artificial Sequence
  Synthetic construct
agatggaatcggatgcagacga

SEQ ID NO: 8442 - DNA, 22 bp, Artificial Sequence
  Synthetic construct
gatggaatcggatgcagacgat

SEQ ID NO: 8443 - DNA, 22 bp, Artificial Sequence
  Synthetic construct
atggaatcggatgcagacgata

SEQ ID NO: 8444 - DNA, 22 bp, Artificial Sequence
  Synthetic construct
tggaatcggatgcagacgataa

SEQ ID NO: 8445 - DNA, 22 bp, Artificial Sequence
  Synthetic construct
ggaatcggatgcagacgataag

SEQ ID NO: 8446 - DNA, 22 bp, Artificial Sequence
  Synthetic construct
gaatcggatgcagacgataagt

SEQ ID NO: 8447 - DNA, 22 bp, Artificial Sequence
  Synthetic construct
aatcggatgcagacgataagtc

SEQ ID NO: 8448 - DNA, 22 bp, Artificial Sequence
  Synthetic construct
atcggatgcagacgataagtct

SEQ ID NO: 8449 - DNA, 22 bp, Artificial Sequence
  Synthetic construct
tcggatgcagacgataagtcta

SEQ ID NO: 8450 - DNA, 22 bp, Artificial Sequence
  Synthetic construct
cggatgcagacgataagtctat

SEQ ID NO: 8451 - DNA, 22 bp, Artificial Sequence
  Synthetic construct
ggatgcagacgataagtctatc

SEQ ID NO: 8452 - DNA, 22 bp, Artificial Sequence
  Synthetic construct
gatgcagacgataagtctatcg

SEQ ID NO: 8453 - DNA, 22 bp, Artificial Sequence
  Synthetic construct
atgcagacgataagtctatcgt

SEQ ID NO: 8454 - DNA, 22 bp, Artificial Sequence
  Synthetic construct
tgcagacgataagtctatcgtc

SEQ ID NO: 8455 - DNA, 22 bp, Artificial Sequence
  Synthetic construct
gcagacgataagtctatcgtcg

SEQ ID NO: 8456 - DNA, 22 bp, Artificial Sequence
  Synthetic construct
cagacgataagtctatcgtcgc

SEQ ID NO: 8457 - DNA, 22 bp, Artificial Sequence
  Synthetic construct
agacgataagtctatcgtcgca

SEQ ID NO: 8458 - DNA, 22 bp, Artificial Sequence
  Synthetic construct
gacgataagtctatcgtcgcaa

SEQ ID NO: 8459 - DNA, 22 bp, Artificial Sequence
  Synthetic construct
acgataagtctatcgtcgcaag

SEQ ID NO: 8460 - DNA, 22 bp, Artificial Sequence
  Synthetic construct
cgataagtctatcgtcgcaagc

SEQ ID NO: 8461 - DNA, 22 bp, Artificial Sequence
  Synthetic construct
gataagtctatcgtcgcaagcg

SEQ ID NO: 8462 - DNA, 22 bp, Artificial Sequence
  Synthetic construct
ataagtctatcgtcgcaagcga

SEQ ID NO: 8463 - DNA, 22 bp, Artificial Sequence
  Synthetic construct
taagtctatcgtcgcaagcgaa

SEQ ID NO: 8464 - DNA, 22 bp, Artificial Sequence
  Synthetic construct
aagtctatcgtcgcaagcgaac

SEQ ID NO: 8465 - DNA, 22 bp, Artificial Sequence
  Synthetic construct
agtctatcgtcgcaagcgaacc

SEQ ID NO: 8466 - DNA, 22 bp, Artificial Sequence
  Synthetic construct
gtctatcgtcgcaagcgaacca

SEQ ID NO: 8467 - DNA, 22 bp, Artificial Sequence
  Synthetic construct
tctatcgtcgcaagcgaaccat

SEQ ID NO: 8468 - DNA, 22 bp, Artificial Sequence
  Synthetic construct
ctatcgtcgcaagcgaaccatc

SEQ ID NO: 8469 - DNA, 22 bp, Artificial Sequence
  Synthetic construct
tatcgtcgcaagcgaaccatct

SEQ ID NO: 8470 - DNA, 22 bp, Artificial Sequence
  Synthetic construct
atcgtcgcaagcgaaccatcta

SEQ ID NO: 8471 - DNA, 22 bp, Artificial Sequence
  Synthetic construct
tcgtcgcaagcgaaccatctac

SEQ ID NO: 8472 - DNA, 22 bp, Artificial Sequence
  Synthetic construct
cgtcgcaagcgaaccatctacg

SEQ ID NO: 8473 - DNA, 22 bp, Artificial Sequence
  Synthetic construct
gtcgcaagcgaaccatctacgc

SEQ ID NO: 8474 - DNA, 22 bp, Artificial Sequence
  Synthetic construct
tcgcaagcgaaccatctacgct

SEQ ID NO: 8475 - DNA, 22 bp, Artificial Sequence
  Synthetic construct
cgcaagcgaaccatctacgctg

SEQ ID NO: 8476 - DNA, 22 bp, Artificial Sequence
  Synthetic construct
gcaagcgaaccatctacgctgc

SEQ ID NO: 8477 - DNA, 22 bp, Artificial Sequence
  Synthetic construct
caagcgaaccatctacgctgcc

SEQ ID NO: 8478 - DNA, 22 bp, Artificial Sequence
  Synthetic construct
aagcgaaccatctacgctgccc

SEQ ID NO: 8479 - DNA, 22 bp, Artificial Sequence
  Synthetic construct
agcgaaccatctacgctgccct

SEQ ID NO: 8480 - DNA, 22 bp, Artificial Sequence
  Synthetic construct
gcgaaccatctacgctgccctg

SEQ ID NO: 8481 - DNA, 22 bp, Artificial Sequence
  Synthetic construct
cgaaccatctacgctgccctgc

SEQ ID NO: 8482 - DNA, 22 bp, Artificial Sequence
  Synthetic construct
gaaccatctacgctgccctgct

SEQ ID NO: 8483 - DNA, 22 bp, Artificial Sequence
  Synthetic construct
aaccatctacgctgccctgctg

SEQ ID NO: 8484 - DNA, 22 bp, Artificial Sequence
  Synthetic construct
accatctacgctgccctgctga

SEQ ID NO: 8485 - DNA, 22 bp, Artificial Sequence
  Synthetic construct
ccatctacgctgccctgctgag

SEQ ID NO: 8486 - DNA, 22 bp, Artificial Sequence
  Synthetic construct
catctacgctgccctgctgagc

SEQ ID NO: 8487 - DNA, 22 bp, Artificial Sequence
  Synthetic construct
atctacgctgccctgctgagcc

SEQ ID NO: 8488 - DNA, 22 bp, Artificial Sequence
  Synthetic construct
tctacgctgccctgctgagcca

SEQ ID NO: 8489 - DNA, 22 bp, Artificial Sequence
  Synthetic construct
ctacgctgccctgctgagccag

SEQ ID NO: 8490 - DNA, 22 bp, Artificial Sequence
  Synthetic construct
tacgctgccctgctgagccaga

SEQ ID NO: 8491 - DNA, 22 bp, Artificial Sequence
  Synthetic construct
acgctgccctgctgagccagac

SEQ ID NO: 8492 - DNA, 22 bp, Artificial Sequence
  Synthetic construct
cgctgccctgctgagccagacg

SEQ ID NO: 8493 - DNA, 22 bp, Artificial Sequence
  Synthetic construct
gctgccctgctgagccagacgc

SEQ ID NO: 8494 - DNA, 22 bp, Artificial Sequence
  Synthetic construct
ctgccctgctgagccagacgct

SEQ ID NO: 8495 - DNA, 22 bp, Artificial Sequence
  Synthetic construct
tgccctgctgagccagacgctg

SEQ ID NO: 8496 - DNA, 22 bp, Artificial Sequence
  Synthetic construct
gccctgctgagccagacgctgg

SEQ ID NO: 8497 - DNA, 22 bp, Artificial Sequence
  Synthetic construct
ccctgctgagccagacgctggt

SEQ ID NO: 8498 - DNA, 22 bp, Artificial Sequence
  Synthetic construct
cctgctgagccagacgctggtt

SEQ ID NO: 8499 - DNA, 22 bp, Artificial Sequence
  Synthetic construct
ctgctgagccagacgctggttg

SEQ ID NO: 8500 - DNA, 22 bp, Artificial Sequence
  Synthetic construct
tgctgagccagacgctggttga

SEQ ID NO: 8501 - DNA, 22 bp, Artificial Sequence
  Synthetic construct
gctgagccagacgctggttgat

SEQ ID NO: 8502 - DNA, 22 bp, Artificial Sequence
  Synthetic construct
ctgagccagacgctggttgatc

SEQ ID NO: 8503 - DNA, 22 bp, Artificial Sequence
  Synthetic construct
tgagccagacgctggttgatcg

SEQ ID NO: 8504 - DNA, 22 bp, Artificial Sequence
  Synthetic construct
gagccagacgctggttgatcga

SEQ ID NO: 8505 - DNA, 22 bp, Artificial Sequence
  Synthetic construct
agccagacgctggttgatcgat

SEQ ID NO: 8506 - DNA, 22 bp, Artificial Sequence
  Synthetic construct
gccagacgctggttgatcgatt

SEQ ID NO: 8507 - DNA, 22 bp, Artificial Sequence
  Synthetic construct
ccagacgctggttgatcgattg

SEQ ID NO: 8508 - DNA, 22 bp, Artificial Sequence
  Synthetic construct
cagacgctggttgatcgattga

SEQ ID NO: 8509 - DNA, 22 bp, Artificial Sequence
  Synthetic construct
agacgctggttgatcgattgat

SEQ ID NO: 8510 - DNA, 22 bp, Artificial Sequence
  Synthetic construct
gacgctggttgatcgattgatc

SEQ ID NO: 8511 - DNA, 22 bp, Artificial Sequence
  Synthetic construct
acgctggttgatcgattgatca

SEQ ID NO: 8512 - DNA, 22 bp, Artificial Sequence
  Synthetic construct
cgctggttgatcgattgatcat

SEQ ID NO: 8513 - DNA, 22 bp, Artificial Sequence
  Synthetic construct
gctggttgatcgattgatcatt

SEQ ID NO: 8514 - DNA, 22 bp, Artificial Sequence
  Synthetic construct
ctggttgatcgattgatcattc

SEQ ID NO: 8515 - DNA, 22 bp, Artificial Sequence
  Synthetic construct
tggttgatcgattgatcattca

SEQ ID NO: 8516 - DNA, 22 bp, Artificial Sequence
  Synthetic construct
ggttgatcgattgatcattcag

SEQ ID NO: 8517 - DNA, 22 bp, Artificial Sequence
  Synthetic construct
gttgatcgattgatcattcagg

SEQ ID NO: 8518 - DNA, 22 bp, Artificial Sequence
  Synthetic construct
ttgatcgattgatcattcaggt

SEQ ID NO: 8519 - DNA, 22 bp, Artificial Sequence
  Synthetic construct
tgatcgattgatcattcaggtc

SEQ ID NO: 8520 - DNA, 22 bp, Artificial Sequence
  Synthetic construct
gatcgattgatcattcaggtct

SEQ ID NO: 8521 - DNA, 22 bp, Artificial Sequence
  Synthetic construct
atcgattgatcattcaggtcta

SEQ ID NO: 8522 - DNA, 22 bp, Artificial Sequence
  Synthetic construct
tcgattgatcattcaggtctat

SEQ ID NO: 8523 - DNA, 22 bp, Artificial Sequence
  Synthetic construct
cgattgatcattcaggtctata

SEQ ID NO: 8524 - DNA, 22 bp, Artificial Sequence
  Synthetic construct
gattgatcattcaggtctatac

SEQ ID NO: 8525 - DNA, 22 bp, Artificial Sequence
  Synthetic construct
attgatcattcaggtctatacc

SEQ ID NO: 8526 - DNA, 22 bp, Artificial Sequence
  Synthetic construct
ttgatcattcaggtctatacca

SEQ ID NO: 8527 - DNA, 22 bp, Artificial Sequence
  Synthetic construct
tgatcattcaggtctataccaa

SEQ ID NO: 8528 - DNA, 22 bp, Artificial Sequence
  Synthetic construct
gatcattcaggtctataccaac

SEQ ID NO: 8529 - DNA, 22 bp, Artificial Sequence
  Synthetic construct
atcattcaggtctataccaacg

SEQ ID NO: 8530 - DNA, 22 bp, Artificial Sequence
  Synthetic construct
tcattcaggtctataccaacgg

SEQ ID NO: 8531 - DNA, 22 bp, Artificial Sequence
  Synthetic construct
cattcaggtctataccaacgga

SEQ ID NO: 8532 - DNA, 22 bp, Artificial Sequence
  Synthetic construct
attcaggtctataccaacggat

SEQ ID NO: 8533 - DNA, 22 bp, Artificial Sequence
  Synthetic construct
ttcaggtctataccaacggatt

SEQ ID NO: 8534 - DNA, 22 bp, Artificial Sequence
  Synthetic construct
tcaggtctataccaacggattt

SEQ ID NO: 8535 - DNA, 22 bp, Artificial Sequence
  Synthetic construct
caggtctataccaacggatttg

SEQ ID NO: 8536 - DNA, 22 bp, Artificial Sequence
  Synthetic construct
aggtctataccaacggatttga

SEQ ID NO: 8537 - DNA, 22 bp, Artificial Sequence
  Synthetic construct
ggtctataccaacggatttgag

SEQ ID NO: 8538 - DNA, 22 bp, Artificial Sequence
  Synthetic construct
gtctataccaacggatttgagc

SEQ ID NO: 8539 - DNA, 22 bp, Artificial Sequence
  Synthetic construct
tctataccaacggatttgagcc

SEQ ID NO: 8540 - DNA, 22 bp, Artificial Sequence
  Synthetic construct
ctataccaacggatttgagccg

SEQ ID NO: 8541 - DNA, 22 bp, Artificial Sequence
  Synthetic construct
tataccaacggatttgagccgg

SEQ ID NO: 8542 - DNA, 22 bp, Artificial Sequence
  Synthetic construct
ataccaacggatttgagccggc

SEQ ID NO: 8543 - DNA, 22 bp, Artificial Sequence
  Synthetic construct
taccaacggatttgagccggcg

SEQ ID NO: 8544 - DNA, 22 bp, Artificial Sequence
  Synthetic construct
accaacggatttgagccggcgt

SEQ ID NO: 8545 - DNA, 22 bp, Artificial Sequence
  Synthetic construct
ccaacggatttgagccggcgtc

SEQ ID NO: 8546 - DNA, 22 bp, Artificial Sequence
  Synthetic construct
caacggatttgagccggcgtct

SEQ ID NO: 8547 - DNA, 22 bp, Artificial Sequence
  Synthetic construct
aacggatttgagccggcgtctg

SEQ ID NO: 8548 - DNA, 22 bp, Artificial Sequence
  Synthetic construct
acggatttgagccggcgtctga

SEQ ID NO: 8549 - DNA, 22 bp, Artificial Sequence
  Synthetic construct
cggatttgagccggcgtctgat

SEQ ID NO: 8550 - DNA, 22 bp, Artificial Sequence
  Synthetic construct
ggatttgagccggcgtctgatg

SEQ ID NO: 8551 - DNA, 22 bp, Artificial Sequence
  Synthetic construct
gatttgagccggcgtctgatga

SEQ ID NO: 8552 - DNA, 22 bp, Artificial Sequence
  Synthetic construct
atttgagccggcgtctgatgaa

SEQ ID NO: 8553 - DNA, 22 bp, Artificial Sequence
  Synthetic construct
tttgagccggcgtctgatgaaa

SEQ ID NO: 8554 - DNA, 22 bp, Artificial Sequence
  Synthetic construct
ttgagccggcgtctgatgaaag

SEQ ID NO: 8555 - DNA, 22 bp, Artificial Sequence
  Synthetic construct
tgagccggcgtctgatgaaagc

SEQ ID NO: 8556 - DNA, 22 bp, Artificial Sequence
  Synthetic construct
gagccggcgtctgatgaaagca

SEQ ID NO: 8557 - DNA, 22 bp, Artificial Sequence
  Synthetic construct
agccggcgtctgatgaaagcac

SEQ ID NO: 8558 - DNA, 22 bp, Artificial Sequence
  Synthetic construct
gccggcgtctgatgaaagcacc

SEQ ID NO: 8559 - DNA, 22 bp, Artificial Sequence
  Synthetic construct
ccggcgtctgatgaaagcaccg

SEQ ID NO: 8560 - DNA, 22 bp, Artificial Sequence
  Synthetic construct
cggcgtctgatgaaagcaccga

SEQ ID NO: 8561 - DNA, 22 bp, Artificial Sequence
  Synthetic construct
ggcgtctgatgaaagcaccgac

SEQ ID NO: 8562 - DNA, 22 bp, Artificial Sequence
  Synthetic construct
gcgtctgatgaaagcaccgacc

SEQ ID NO: 8563 - DNA, 22 bp, Artificial Sequence
  Synthetic construct
cgtctgatgaaagcaccgaccc

SEQ ID NO: 8564 - DNA, 22 bp, Artificial Sequence
  Synthetic construct
gtctgatgaaagcaccgacccc

SEQ ID NO: 8565 - DNA, 22 bp, Artificial Sequence
  Synthetic construct
tctgatgaaagcaccgacccct

SEQ ID NO: 8566 - DNA, 22 bp, Artificial Sequence
  Synthetic construct
ctgatgaaagcaccgacccctt

SEQ ID NO: 8567 - DNA, 22 bp, Artificial Sequence
  Synthetic construct
tgatgaaagcaccgaccccttt

SEQ ID NO: 8568 - DNA, 22 bp, Artificial Sequence
  Synthetic construct
gatgaaagcaccgacccctttc

SEQ ID NO: 8569 - DNA, 22 bp, Artificial Sequence
  Synthetic construct
atgaaagcaccgacccctttct

SEQ ID NO: 8570 - DNA, 22 bp, Artificial Sequence
  Synthetic construct
tgaaagcaccgacccctttctg

SEQ ID NO: 8571 - DNA, 22 bp, Artificial Sequence
  Synthetic construct
gaaagcaccgacccctttctgg

SEQ ID NO: 8572 - DNA, 22 bp, Artificial Sequence
  Synthetic construct
aaagcaccgacccctttctgga

SEQ ID NO: 8573 - DNA, 22 bp, Artificial Sequence
  Synthetic construct
aagcaccgacccctttctggag

SEQ ID NO: 8574 - DNA, 22 bp, Artificial Sequence
  Synthetic construct
agcaccgacccctttctggagg

SEQ ID NO: 8575 - DNA, 22 bp, Artificial Sequence
  Synthetic construct
gcaccgacccctttctggaggt

SEQ ID NO: 8576 - DNA, 22 bp, Artificial Sequence
  Synthetic construct
caccgacccctttctggaggta

SEQ ID NO: 8577 - DNA, 22 bp, Artificial Sequence
  Synthetic construct
accgacccctttctggaggtac

SEQ ID NO: 8578 - DNA, 22 bp, Artificial Sequence
  Synthetic construct
ccgacccctttctggaggtaca

SEQ ID NO: 8579 - DNA, 22 bp, Artificial Sequence
  Synthetic construct
cgacccctttctggaggtacat

SEQ ID NO: 8580 - DNA, 22 bp, Artificial Sequence
  Synthetic construct
gacccctttctggaggtacata

SEQ ID NO: 8581 - DNA, 22 bp, Artificial Sequence
  Synthetic construct
acccctttctggaggtacatat

SEQ ID NO: 8582 - DNA, 22 bp, Artificial Sequence
  Synthetic construct
cccctttctggaggtacatatt

SEQ ID NO: 8583 - DNA, 22 bp, Artificial Sequence
  Synthetic construct
ccctttctggaggtacatattc

SEQ ID NO: 8584 - DNA, 22 bp, Artificial Sequence
  Synthetic construct
cctttctggaggtacatattca

SEQ ID NO: 8585 - DNA, 22 bp, Artificial Sequence
  Synthetic construct
ctttctggaggtacatattcat

SEQ ID NO: 8586 - DNA, 22 bp, Artificial Sequence
  Synthetic construct
tttctggaggtacatattcata

SEQ ID NO: 8587 - DNA, 22 bp, Artificial Sequence
  Synthetic construct
ttctggaggtacatattcatat

SEQ ID NO: 8588 - DNA, 22 bp, Artificial Sequence
  Synthetic construct
tctggaggtacatattcatatc

SEQ ID NO: 8589 - DNA, 22 bp, Artificial Sequence
  Synthetic construct
ctggaggtacatattcatatca

SEQ ID NO: 8590 - DNA, 22 bp, Artificial Sequence
  Synthetic construct
tggaggtacatattcatatcag

SEQ ID NO: 8591 - DNA, 22 bp, Artificial Sequence
  Synthetic construct
ggaggtacatattcatatcagg

SEQ ID NO: 8592 - DNA, 22 bp, Artificial Sequence
  Synthetic construct
gaggtacatattcatatcaggc

SEQ ID NO: 8593 - DNA, 22 bp, Artificial Sequence
  Synthetic construct
aggtacatattcatatcaggct

SEQ ID NO: 8594 - DNA, 22 bp, Artificial Sequence
  Synthetic construct
ggtacatattcatatcaggctc

SEQ ID NO: 8595 - DNA, 22 bp, Artificial Sequence
  Synthetic construct
gtacatattcatatcaggctcc

SEQ ID NO: 8596 - DNA, 22 bp, Artificial Sequence
  Synthetic construct
tacatattcatatcaggctcct

SEQ ID NO: 8597 - DNA, 22 bp, Artificial Sequence
  Synthetic construct
acatattcatatcaggctcctt

SEQ ID NO: 8598 - DNA, 22 bp, Artificial Sequence
  Synthetic construct
catattcatatcaggctcctta

SEQ ID NO: 8599 - DNA, 22 bp, Artificial Sequence
  Synthetic construct
atattcatatcaggctccttac

SEQ ID NO: 8600 - DNA, 22 bp, Artificial Sequence
  Synthetic construct
tattcatatcaggctccttaca

SEQ ID NO: 8601 - DNA, 22 bp, Artificial Sequence
  Synthetic construct
attcatatcaggctccttacag

SEQ ID NO: 8602 - DNA, 22 bp, Artificial Sequence
  Synthetic construct
ttcatatcaggctccttacagg

SEQ ID NO: 8603 - DNA, 22 bp, Artificial Sequence
  Synthetic construct
tcatatcaggctccttacaggc

SEQ ID NO: 8604 - DNA, 22 bp, Artificial Sequence
  Synthetic construct
catatcaggctccttacaggca

SEQ ID NO: 8605 - DNA, 22 bp, Artificial Sequence
  Synthetic construct
atatcaggctccttacaggcag

SEQ ID NO: 8606 - DNA, 22 bp, Artificial Sequence
  Synthetic construct
tatcaggctccttacaggcagc

SEQ ID NO: 8607 - DNA, 22 bp, Artificial Sequence
  Synthetic construct
atcaggctccttacaggcagcc

SEQ ID NO: 8608 - DNA, 22 bp, Artificial Sequence
  Synthetic construct
tcaggctccttacaggcagccc

SEQ ID NO: 8609 - DNA, 22 bp, Artificial Sequence
  Synthetic construct
caggctccttacaggcagcccg

SEQ ID NO: 8610 - DNA, 22 bp, Artificial Sequence
  Synthetic construct
aggctccttacaggcagcccga

SEQ ID NO: 8611 - DNA, 22 bp, Artificial Sequence
  Synthetic construct
ggctccttacaggcagcccgat

SEQ ID NO: 8612 - DNA, 22 bp, Artificial Sequence
  Synthetic construct
gctccttacaggcagcccgatc

SEQ ID NO: 8613 - DNA, 22 bp, Artificial Sequence
  Synthetic construct
ctccttacaggcagcccgatct

SEQ ID NO: 8614 - DNA, 22 bp, Artificial Sequence
  Synthetic construct
tccttacaggcagcccgatcta

SEQ ID NO: 8615 - DNA, 22 bp, Artificial Sequence
  Synthetic construct
ccttacaggcagcccgatctat

SEQ ID NO: 8616 - DNA, 22 bp, Artificial Sequence
  Synthetic construct
cttacaggcagcccgatctatt

SEQ ID NO: 8617 - DNA, 22 bp, Artificial Sequence
  Synthetic construct
ttacaggcagcccgatctattt

SEQ ID NO: 8618 - DNA, 22 bp, Artificial Sequence
  Synthetic construct
tacaggcagcccgatctatttt

SEQ ID NO: 8619 - DNA, 22 bp, Artificial Sequence
  Synthetic construct
acaggcagcccgatctatttta

SEQ ID NO: 8620 - DNA, 22 bp, Artificial Sequence
  Synthetic construct
caggcagcccgatctattttat

SEQ ID NO: 8621 - DNA, 22 bp, Artificial Sequence
  Synthetic construct
aggcagcccgatctattttatt

SEQ ID NO: 8622 - DNA, 22 bp, Artificial Sequence
  Synthetic construct
ggcagcccgatctattttatta

SEQ ID NO: 8623 - DNA, 22 bp, Artificial Sequence
  Synthetic construct
gcagcccgatctattttattat

SEQ ID NO: 8624 - DNA, 22 bp, Artificial Sequence
  Synthetic construct
cagcccgatctattttattatt

SEQ ID NO: 8625 - DNA, 22 bp, Artificial Sequence
  Synthetic construct
agcccgatctattttattattc

SEQ ID NO: 8626 - DNA, 22 bp, Artificial Sequence
  Synthetic construct
gcccgatctattttattattct

SEQ ID NO: 8627 - DNA, 22 bp, Artificial Sequence
  Synthetic construct
cccgatctattttattattctt

SEQ ID NO: 8628 - DNA, 22 bp, Artificial Sequence
  Synthetic construct
ccgatctattttattattcttc

SEQ ID NO: 8629 - DNA, 22 bp, Artificial Sequence
  Synthetic construct
cgatctattttattattcttcg

SEQ ID NO: 8630 - DNA, 22 bp, Artificial Sequence
  Synthetic construct
gatctattttattattcttcgg

SEQ ID NO: 8631 - DNA, 22 bp, Artificial Sequence
  Synthetic construct
atctattttattattcttcgga

SEQ ID NO: 8632 - DNA, 22 bp, Artificial Sequence
  Synthetic construct
tctattttattattcttcggaa

SEQ ID NO: 8633 - DNA, 22 bp, Artificial Sequence
  Synthetic construct
ctattttattattcttcggaac

SEQ ID NO: 8634 - DNA, 22 bp, Artificial Sequence
  Synthetic construct
tattttattattcttcggaact

SEQ ID NO: 8635 - DNA, 22 bp, Artificial Sequence
  Synthetic construct
attttattattcttcggaactg

SEQ ID NO: 8636 - DNA, 22 bp, Artificial Sequence
  Synthetic construct
ttttattattcttcggaactgt

SEQ ID NO: 8637 - DNA, 22 bp, Artificial Sequence
  Synthetic construct
tttattattcttcggaactgta

SEQ ID NO: 8638 - DNA, 22 bp, Artificial Sequence
  Synthetic construct
ttattattcttcggaactgtaa

SEQ ID NO: 8639 - DNA, 22 bp, Artificial Sequence
  Synthetic construct
tattattcttcggaactgtaaa

SEQ ID NO: 8640 - DNA, 22 bp, Artificial Sequence
  Synthetic construct
attattcttcggaactgtaaac

SEQ ID NO: 8641 - DNA, 22 bp, Artificial Sequence
  Synthetic construct
ttattcttcggaactgtaaaca

SEQ ID NO: 8642 - DNA, 22 bp, Artificial Sequence
  Synthetic construct
tattcttcggaactgtaaacac

SEQ ID NO: 8643 - DNA, 22 bp, Artificial Sequence
  Synthetic construct
attcttcggaactgtaaacact

SEQ ID NO: 8644 - DNA, 22 bp, Artificial Sequence
  Synthetic construct
ttcttcggaactgtaaacactc

SEQ ID NO: 8645 - DNA, 22 bp, Artificial Sequence
  Synthetic construct
tcttcggaactgtaaacactcc

SEQ ID NO: 8646 - DNA, 22 bp, Artificial Sequence
  Synthetic construct
cttcggaactgtaaacactccg

SEQ ID NO: 8647 - DNA, 22 bp, Artificial Sequence
  Synthetic construct
ttcggaactgtaaacactccgt

SEQ ID NO: 8648 - DNA, 22 bp, Artificial Sequence
  Synthetic construct
tcggaactgtaaacactccgtt

SEQ ID NO: 8649 - DNA, 22 bp, Artificial Sequence
  Synthetic construct
cggaactgtaaacactccgttc

SEQ ID NO: 8650 - DNA, 22 bp, Artificial Sequence
  Synthetic construct
ggaactgtaaacactccgttcc

SEQ ID NO: 8651 - DNA, 22 bp, Artificial Sequence
  Synthetic construct
gaactgtaaacactccgttccc

SEQ ID NO: 8652 - DNA, 22 bp, Artificial Sequence
  Synthetic construct
aactgtaaacactccgttccct

SEQ ID NO: 8653 - DNA, 22 bp, Artificial Sequence
  Synthetic construct
actgtaaacactccgttcccta

SEQ ID NO: 8654 - DNA, 22 bp, Artificial Sequence
  Synthetic construct
ctgtaaacactccgttccctac

SEQ ID NO: 8655 - DNA, 22 bp, Artificial Sequence
  Synthetic construct
tgtaaacactccgttccctaca

SEQ ID NO: 8656 - DNA, 22 bp, Artificial Sequence
  Synthetic construct
gtaaacactccgttccctacaa

SEQ ID NO: 8657 - DNA, 22 bp, Artificial Sequence
  Synthetic construct
taaacactccgttccctacaac

SEQ ID NO: 8658 - DNA, 22 bp, Artificial Sequence
  Synthetic construct
aaacactccgttccctacaacg

SEQ ID NO: 8659 - DNA, 22 bp, Artificial Sequence
  Synthetic construct
aacactccgttccctacaacga

SEQ ID NO: 8660 - DNA, 22 bp, Artificial Sequence
  Synthetic construct
acactccgttccctacaacgag

SEQ ID NO: 8661 - DNA, 22 bp, Artificial Sequence
  Synthetic construct
cactccgttccctacaacgagc

SEQ ID NO: 8662 - DNA, 22 bp, Artificial Sequence
  Synthetic construct
actccgttccctacaacgagcc

SEQ ID NO: 8663 - DNA, 22 bp, Artificial Sequence
  Synthetic construct
ctccgttccctacaacgagcct

SEQ ID NO: 8664 - DNA, 22 bp, Artificial Sequence
  Synthetic construct
tccgttccctacaacgagccta

SEQ ID NO: 8665 - DNA, 22 bp, Artificial Sequence
  Synthetic construct
ccgttccctacaacgagcctaa

SEQ ID NO: 8666 - DNA, 22 bp, Artificial Sequence
  Synthetic construct
cgttccctacaacgagcctaaa

SEQ ID NO: 8667 - DNA, 22 bp, Artificial Sequence
  Synthetic construct
gttccctacaacgagcctaaat

SEQ ID NO: 8668 - DNA, 22 bp, Artificial Sequence
  Synthetic construct
ttccctacaacgagcctaaatt

SEQ ID NO: 8669 - DNA, 22 bp, Artificial Sequence
  Synthetic construct
tccctacaacgagcctaaattc

SEQ ID NO: 8670 - DNA, 22 bp, Artificial Sequence
  Synthetic construct
ccctacaacgagcctaaattca

SEQ ID NO: 8671 - DNA, 22 bp, Artificial Sequence
  Synthetic construct
cctacaacgagcctaaattcat

SEQ ID NO: 8672 - DNA, 22 bp, Artificial Sequence
  Synthetic construct
ctacaacgagcctaaattcata

SEQ ID NO: 8673 - DNA, 22 bp, Artificial Sequence
  Synthetic construct
tacaacgagcctaaattcatat

SEQ ID NO: 8674 - DNA, 22 bp, Artificial Sequence
  Synthetic construct
acaacgagcctaaattcatatg

SEQ ID NO: 8675 - DNA, 22 bp, Artificial Sequence
  Synthetic construct
caacgagcctaaattcatatga

SEQ ID NO: 8676 - DNA, 22 bp, Artificial Sequence
  Synthetic construct
aacgagcctaaattcatatgac

SEQ ID NO: 8677 - DNA, 22 bp, Artificial Sequence
  Synthetic construct
acgagcctaaattcatatgact

SEQ ID NO: 8678 - DNA, 22 bp, Artificial Sequence
  Synthetic construct
cgagcctaaattcatatgactc

SEQ ID NO: 8679 - DNA, 22 bp, Artificial Sequence
  Synthetic construct
gagcctaaattcatatgactcg

SEQ ID NO: 8680 - DNA, 22 bp, Artificial Sequence
  Synthetic construct
agcctaaattcatatgactcgt

SEQ ID NO: 8681 - DNA, 22 bp, Artificial Sequence
  Synthetic construct
gcctaaattcatatgactcgtt

SEQ ID NO: 8682 - DNA, 22 bp, Artificial Sequence
  Synthetic construct
cctaaattcatatgactcgtta

SEQ ID NO: 8683 - DNA, 22 bp, Artificial Sequence
  Synthetic construct
ctaaattcatatgactcgttat

SEQ ID NO: 8684 - DNA, 22 bp, Artificial Sequence
  Synthetic construct
taaattcatatgactcgttata

SEQ ID NO: 8685 - DNA, 22 bp, Artificial Sequence
  Synthetic construct
aaattcatatgactcgttatag

SEQ ID NO: 8686 - DNA, 22 bp, Artificial Sequence
  Synthetic construct
aattcatatgactcgttatagc

SEQ ID NO: 8687 - DNA, 22 bp, Artificial Sequence
  Synthetic construct
attcatatgactcgttatagcg

SEQ ID NO: 8688 - DNA, 22 bp, Artificial Sequence
  Synthetic construct
ttcatatgactcgttatagcgg

SEQ ID NO: 8689 - DNA, 22 bp, Artificial Sequence
  Synthetic construct
tcatatgactcgttatagcgga

SEQ ID NO: 8690 - DNA, 22 bp, Artificial Sequence
  Synthetic construct
catatgactcgttatagcggac

SEQ ID NO: 8691 - DNA, 22 bp, Artificial Sequence
  Synthetic construct
atatgactcgttatagcggacc

SEQ ID NO: 8692 - DNA, 22 bp, Artificial Sequence
  Synthetic construct
tatgactcgttatagcggaccg

SEQ ID NO: 8693 - DNA, 22 bp, Artificial Sequence
  Synthetic construct
atgactcgttatagcggaccgc

SEQ ID NO: 8694 - DNA, 22 bp, Artificial Sequence
  Synthetic construct
tgactcgttatagcggaccgcg

SEQ ID NO: 8695 - DNA, 22 bp, Artificial Sequence
  Synthetic construct
gactcgttatagcggaccgcgt

SEQ ID NO: 8696 - DNA, 22 bp, Artificial Sequence
  Synthetic construct
actcgttatagcggaccgcgtg

SEQ ID NO: 8697 - DNA, 22 bp, Artificial Sequence
  Synthetic construct
ctcgttatagcggaccgcgtgt

SEQ ID NO: 8698 - DNA, 22 bp, Artificial Sequence
  Synthetic construct
tcgttatagcggaccgcgtgtc

SEQ ID NO: 8699 - DNA, 22 bp, Artificial Sequence
  Synthetic construct
cgttatagcggaccgcgtgtct

SEQ ID NO: 8700 - DNA, 22 bp, Artificial Sequence
  Synthetic construct
gttatagcggaccgcgtgtctg

SEQ ID NO: 8701 - DNA, 22 bp, Artificial Sequence
  Synthetic construct
ttatagcggaccgcgtgtctga

SEQ ID NO: 8702 - DNA, 22 bp, Artificial Sequence
  Synthetic construct
tatagcggaccgcgtgtctgat

SEQ ID NO: 8703 - DNA, 22 bp, Artificial Sequence
  Synthetic construct
atagcggaccgcgtgtctgatc

SEQ ID NO: 8704 - DNA, 22 bp, Artificial Sequence
  Synthetic construct
tagcggaccgcgtgtctgatcc

SEQ ID NO: 8705 - DNA, 22 bp, Artificial Sequence
  Synthetic construct
agcggaccgcgtgtctgatcca

SEQ ID NO: 8706 - DNA, 22 bp, Artificial Sequence
  Synthetic construct
gcggaccgcgtgtctgatccac

SEQ ID NO: 8707 - DNA, 22 bp, Artificial Sequence
  Synthetic construct
cggaccgcgtgtctgatccacg

SEQ ID NO: 8708 - DNA, 22 bp, Artificial Sequence
  Synthetic construct
ggaccgcgtgtctgatccacgg

SEQ ID NO: 8709 - DNA, 22 bp, Artificial Sequence
  Synthetic construct
gaccgcgtgtctgatccacggc

SEQ ID NO: 8710 - DNA, 22 bp, Artificial Sequence
  Synthetic construct
accgcgtgtctgatccacggcg

SEQ ID NO: 8711 - DNA, 22 bp, Artificial Sequence
  Synthetic construct
ccgcgtgtctgatccacggcgc

SEQ ID NO: 8712 - DNA, 22 bp, Artificial Sequence
  Synthetic construct
cgcgtgtctgatccacggcgca

SEQ ID NO: 8713 - DNA, 22 bp, Artificial Sequence
  Synthetic construct
gcgtgtctgatccacggcgcac

SEQ ID NO: 8714 - DNA, 22 bp, Artificial Sequence
  Synthetic construct
cgtgtctgatccacggcgcaca

SEQ ID NO: 8715 - DNA, 22 bp, Artificial Sequence
  Synthetic construct
gtgtctgatccacggcgcacat

SEQ ID NO: 8716 - DNA, 22 bp, Artificial Sequence
  Synthetic construct
tgtctgatccacggcgcacatt

SEQ ID NO: 8717 - DNA, 22 bp, Artificial Sequence
  Synthetic construct
gtctgatccacggcgcacattg

SEQ ID NO: 8718 - DNA, 22 bp, Artificial Sequence
  Synthetic construct
tctgatccacggcgcacattgg

SEQ ID NO: 8719 - DNA, 22 bp, Artificial Sequence
  Synthetic construct
ctgatccacggcgcacattggt

SEQ ID NO: 8720 - DNA, 22 bp, Artificial Sequence
  Synthetic construct
tgatccacggcgcacattggtc

SEQ ID NO: 8721 - DNA, 22 bp, Artificial Sequence
  Synthetic construct
gatccacggcgcacattggtct

SEQ ID NO: 8722 - DNA, 22 bp, Artificial Sequence
  Synthetic construct
atccacggcgcacattggtctc

SEQ ID NO: 8723 - DNA, 22 bp, Artificial Sequence
  Synthetic construct
tccacggcgcacattggtctcg

SEQ ID NO: 8724 - DNA, 22 bp, Artificial Sequence
  Synthetic construct
ccacggcgcacattggtctcgg

SEQ ID NO: 8725 - DNA, 22 bp, Artificial Sequence
  Synthetic construct
cacggcgcacattggtctcgga

SEQ ID NO: 8726 - DNA, 22 bp, Artificial Sequence
  Synthetic construct
acggcgcacattggtctcggac

SEQ ID NO: 8727 - DNA, 22 bp, Artificial Sequence
  Synthetic construct
cggcgcacattggtctcggacc

SEQ ID NO: 8728 - DNA, 22 bp, Artificial Sequence
  Synthetic construct
ggcgcacattggtctcggacca

SEQ ID NO: 8729 - DNA, 22 bp, Artificial Sequence
  Synthetic construct
gcgcacattggtctcggaccaa

SEQ ID NO: 8730 - DNA, 22 bp, Artificial Sequence
  Synthetic construct
cgcacattggtctcggaccaat

SEQ ID NO: 8731 - DNA, 22 bp, Artificial Sequence
  Synthetic construct
gcacattggtctcggaccaata

SEQ ID NO: 8732 - DNA, 22 bp, Artificial Sequence
  Synthetic construct
cacattggtctcggaccaatag

SEQ ID NO: 8733 - DNA, 22 bp, Artificial Sequence
  Synthetic construct
acattggtctcggaccaataga

SEQ ID NO: 8734 - DNA, 22 bp, Artificial Sequence
  Synthetic construct
cattggtctcggaccaatagag

SEQ ID NO: 8735 - DNA, 22 bp, Artificial Sequence
  Synthetic construct
attggtctcggaccaatagagc

SEQ ID NO: 8736 - DNA, 22 bp, Artificial Sequence
  Synthetic construct
ttggtctcggaccaatagagcc

SEQ ID NO: 8737 - DNA, 22 bp, Artificial Sequence
  Synthetic construct
tggtctcggaccaatagagccg

SEQ ID NO: 8738 - DNA, 22 bp, Artificial Sequence
  Synthetic construct
ggtctcggaccaatagagccgc

SEQ ID NO: 8739 - DNA, 22 bp, Artificial Sequence
  Synthetic construct
gtctcggaccaatagagccgct

SEQ ID NO: 8740 - DNA, 22 bp, Artificial Sequence
  Synthetic construct
tctcggaccaatagagccgctc

SEQ ID NO: 8741 - DNA, 22 bp, Artificial Sequence
  Synthetic construct
ctcggaccaatagagccgctct

SEQ ID NO: 8742 - DNA, 22 bp, Artificial Sequence
  Synthetic construct
tcggaccaatagagccgctctc

SEQ ID NO: 8743 - DNA, 22 bp, Artificial Sequence
  Synthetic construct
cggaccaatagagccgctctca

SEQ ID NO: 8744 - DNA, 22 bp, Artificial Sequence
  Synthetic construct
ggaccaatagagccgctctcag

SEQ ID NO: 8745 - DNA, 22 bp, Artificial Sequence
  Synthetic construct
gaccaatagagccgctctcaga

SEQ ID NO: 8746 - DNA, 22 bp, Artificial Sequence
  Synthetic construct
accaatagagccgctctcagag

SEQ ID NO: 8747 - DNA, 22 bp, Artificial Sequence
  Synthetic construct
ccaatagagccgctctcagagc

SEQ ID NO: 8748 - DNA, 22 bp, Artificial Sequence
  Synthetic construct
caatagagccgctctcagagcg

SEQ ID NO: 8749 - DNA, 22 bp, Artificial Sequence
  Synthetic construct
aatagagccgctctcagagcgc

SEQ ID NO: 8750 - DNA, 22 bp, Artificial Sequence
  Synthetic construct
atagagccgctctcagagcgcg

SEQ ID NO: 8751 - DNA, 22 bp, Artificial Sequence
  Synthetic construct
tagagccgctctcagagcgcgg

SEQ ID NO: 8752 - DNA, 22 bp, Artificial Sequence
  Synthetic construct
agagccgctctcagagcgcggg

SEQ ID NO: 8753 - DNA, 22 bp, Artificial Sequence
  Synthetic construct
gagccgctctcagagcgcgggg

SEQ ID NO: 8754 - DNA, 22 bp, Artificial Sequence
  Synthetic construct
agccgctctcagagcgcggggg

SEQ ID NO: 8755 - DNA, 22 bp, Artificial Sequence
  Synthetic construct
gccgctctcagagcgcgggggg

SEQ ID NO: 8756 - DNA, 22 bp, Artificial Sequence
  Synthetic construct
ccgctctcagagcgcggggggt

SEQ ID NO: 8757 - DNA, 22 bp, Artificial Sequence
  Synthetic construct
cgctctcagagcgcggggggta

SEQ ID NO: 8758 - DNA, 22 bp, Artificial Sequence
  Synthetic construct
gctctcagagcgcggggggtaa

SEQ ID NO: 8759 - DNA, 22 bp, Artificial Sequence
  Synthetic construct
ctctcagagcgcggggggtaac

SEQ ID NO: 8760 - DNA, 22 bp, Artificial Sequence
  Synthetic construct
tctcagagcgcggggggtaacg

SEQ ID NO: 8761 - DNA, 22 bp, Artificial Sequence
  Synthetic construct
ctcagagcgcggggggtaacgg

SEQ ID NO: 8762 - DNA, 22 bp, Artificial Sequence
  Synthetic construct
tcagagcgcggggggtaacggt

SEQ ID NO: 8763 - DNA, 22 bp, Artificial Sequence
  Synthetic construct
cagagcgcggggggtaacggtt

SEQ ID NO: 8764 - DNA, 22 bp, Artificial Sequence
  Synthetic construct
agagcgcggggggtaacggttg

SEQ ID NO: 8765 - DNA, 22 bp, Artificial Sequence
  Synthetic construct
gagcgcggggggtaacggttgc

SEQ ID NO: 8766 - DNA, 22 bp, Artificial Sequence
  Synthetic construct
agcgcggggggtaacggttgct

SEQ ID NO: 8767 - DNA, 22 bp, Artificial Sequence
  Synthetic construct
gcgcggggggtaacggttgctt

SEQ ID NO: 8768 - DNA, 22 bp, Artificial Sequence
  Synthetic construct
cgcggggggtaacggttgcttg

SEQ ID NO: 8769 - DNA, 22 bp, Artificial Sequence
  Synthetic construct
gcggggggtaacggttgcttgt

SEQ ID NO: 8770 - DNA, 22 bp, Artificial Sequence
  Synthetic construct
cggggggtaacggttgcttgtt

SEQ ID NO: 8771 - DNA, 22 bp, Artificial Sequence
  Synthetic construct
ggggggtaacggttgcttgttc

SEQ ID NO: 8772 - DNA, 22 bp, Artificial Sequence
  Synthetic construct
gggggtaacggttgcttgttca

SEQ ID NO: 8773 - DNA, 22 bp, Artificial Sequence
  Synthetic construct
ggggtaacggttgcttgttcag

SEQ ID NO: 8774 - DNA, 22 bp, Artificial Sequence
  Synthetic construct
gggtaacggttgcttgttcagc

SEQ ID NO: 8775 - DNA, 22 bp, Artificial Sequence
  Synthetic construct
ggtaacggttgcttgttcagcg

SEQ ID NO: 8776 - DNA, 22 bp, Artificial Sequence
  Synthetic construct
gtaacggttgcttgttcagcga

SEQ ID NO: 8777 - DNA, 22 bp, Artificial Sequence
  Synthetic construct
taacggttgcttgttcagcgaa

SEQ ID NO: 8778 - DNA, 22 bp, Artificial Sequence
  Synthetic construct
aacggttgcttgttcagcgaac

SEQ ID NO: 8779 - DNA, 22 bp, Artificial Sequence
  Synthetic construct
acggttgcttgttcagcgaact

SEQ ID NO: 8780 - DNA, 22 bp, Artificial Sequence
  Synthetic construct
cggttgcttgttcagcgaactt

SEQ ID NO: 8781 - DNA, 22 bp, Artificial Sequence
  Synthetic construct
ggttgcttgttcagcgaacttc

SEQ ID NO: 8782 - DNA, 22 bp, Artificial Sequence
  Synthetic construct
gttgcttgttcagcgaacttct

SEQ ID NO: 8783 - DNA, 22 bp, Artificial Sequence
  Synthetic construct
ttgcttgttcagcgaacttctt

SEQ ID NO: 8784 - DNA, 22 bp, Artificial Sequence
  Synthetic construct
tgcttgttcagcgaacttcttg

SEQ ID NO: 8785 - DNA, 22 bp, Artificial Sequence
  Synthetic construct
gcttgttcagcgaacttcttgt

SEQ ID NO: 8786 - DNA, 22 bp, Artificial Sequence
  Synthetic construct
cttgttcagcgaacttcttgta

SEQ ID NO: 8787 - DNA, 22 bp, Artificial Sequence
  Synthetic construct
ttgttcagcgaacttcttgtaa

SEQ ID NO: 8788 - DNA, 22 bp, Artificial Sequence
  Synthetic construct
tgttcagcgaacttcttgtaag

SEQ ID NO: 8789 - DNA, 22 bp, Artificial Sequence
  Synthetic construct
gttcagcgaacttcttgtaagg

SEQ ID NO: 8790 - DNA, 22 bp, Artificial Sequence
  Synthetic construct
ttcagcgaacttcttgtaaggc

SEQ ID NO: 8791 - DNA, 22 bp, Artificial Sequence
  Synthetic construct
tcagcgaacttcttgtaaggcg

SEQ ID NO: 8792 - DNA, 22 bp, Artificial Sequence
  Synthetic construct
cagcgaacttcttgtaaggcgc

SEQ ID NO: 8793 - DNA, 22 bp, Artificial Sequence
  Synthetic construct
agcgaacttcttgtaaggcgct

SEQ ID NO: 8794 - DNA, 22 bp, Artificial Sequence
  Synthetic construct
gcgaacttcttgtaaggcgctg

SEQ ID NO: 8795 - DNA, 22 bp, Artificial Sequence
  Synthetic construct
cgaacttcttgtaaggcgctgc

SEQ ID NO: 8796 - DNA, 22 bp, Artificial Sequence
  Synthetic construct
gaacttcttgtaaggcgctgca

SEQ ID NO: 8797 - DNA, 22 bp, Artificial Sequence
  Synthetic construct
aacttcttgtaaggcgctgcat

SEQ ID NO: 8798 - DNA, 22 bp, Artificial Sequence
  Synthetic construct
acttcttgtaaggcgctgcatc

SEQ ID NO: 8799 - DNA, 22 bp, Artificial Sequence
  Synthetic construct
cttcttgtaaggcgctgcatcc

SEQ ID NO: 8800 - DNA, 22 bp, Artificial Sequence
  Synthetic construct
ttcttgtaaggcgctgcatcct

SEQ ID NO: 8801 - DNA, 22 bp, Artificial Sequence
  Synthetic construct
tcttgtaaggcgctgcatcctg

SEQ ID NO: 8802 - DNA, 22 bp, Artificial Sequence
  Synthetic construct
cttgtaaggcgctgcatcctgc

SEQ ID NO: 8803 - DNA, 22 bp, Artificial Sequence
  Synthetic construct
ttgtaaggcgctgcatcctgca

SEQ ID NO: 8804 - DNA, 22 bp, Artificial Sequence
  Synthetic construct
tgtaaggcgctgcatcctgcaa

SEQ ID NO: 8805 - DNA, 22 bp, Artificial Sequence
  Synthetic construct
gtaaggcgctgcatcctgcaac

SEQ ID NO: 8806 - DNA, 22 bp, Artificial Sequence
  Synthetic construct
taaggcgctgcatcctgcaact

SEQ ID NO: 8807 - DNA, 22 bp, Artificial Sequence
  Synthetic construct
aaggcgctgcatcctgcaactt

SEQ ID NO: 8808 - DNA, 22 bp, Artificial Sequence
  Synthetic construct
aggcgctgcatcctgcaacttg

SEQ ID NO: 8809 - DNA, 22 bp, Artificial Sequence
  Synthetic construct
ggcgctgcatcctgcaacttgt

SEQ ID NO: 8810 - DNA, 22 bp, Artificial Sequence
  Synthetic construct
gcgctgcatcctgcaacttgtg

SEQ ID NO: 8811 - DNA, 22 bp, Artificial Sequence
  Synthetic construct
cgctgcatcctgcaacttgtgc

SEQ ID NO: 8812 - DNA, 22 bp, Artificial Sequence
  Synthetic construct
gctgcatcctgcaacttgtgcc

SEQ ID NO: 8813 - DNA, 22 bp, Artificial Sequence
  Synthetic construct
ctgcatcctgcaacttgtgccc

SEQ ID NO: 8814 - DNA, 22 bp, Artificial Sequence
  Synthetic construct
tgcatcctgcaacttgtgcccc

SEQ ID NO: 8815 - DNA, 22 bp, Artificial Sequence
  Synthetic construct
gcatcctgcaacttgtgcccca

SEQ ID NO: 8816 - DNA, 22 bp, Artificial Sequence
  Synthetic construct
catcctgcaacttgtgccccat

SEQ ID NO: 8817 - DNA, 22 bp, Artificial Sequence
  Synthetic construct
atcctgcaacttgtgccccata

SEQ ID NO: 8818 - DNA, 22 bp, Artificial Sequence
  Synthetic construct
tcctgcaacttgtgccccatag

SEQ ID NO: 8819 - DNA, 22 bp, Artificial Sequence
  Synthetic construct
cctgcaacttgtgccccatagg

SEQ ID NO: 8820 - DNA, 22 bp, Artificial Sequence
  Synthetic construct
ctgcaacttgtgccccatagga

SEQ ID NO: 8821 - DNA, 22 bp, Artificial Sequence
  Synthetic construct
tgcaacttgtgccccataggag

SEQ ID NO: 8822 - DNA, 22 bp, Artificial Sequence
  Synthetic construct
gcaacttgtgccccataggagc

SEQ ID NO: 8823 - DNA, 22 bp, Artificial Sequence
  Synthetic construct
caacttgtgccccataggagca

SEQ ID NO: 8824 - DNA, 22 bp, Artificial Sequence
  Synthetic construct
aacttgtgccccataggagcac

SEQ ID NO: 8825 - DNA, 22 bp, Artificial Sequence
  Synthetic construct
acttgtgccccataggagcacc

SEQ ID NO: 8826 - DNA, 22 bp, Artificial Sequence
  Synthetic construct
cttgtgccccataggagcaccg

SEQ ID NO: 8827 - DNA, 22 bp, Artificial Sequence
  Synthetic construct
ttgtgccccataggagcaccgt

SEQ ID NO: 8828 - DNA, 22 bp, Artificial Sequence
  Synthetic construct
tgtgccccataggagcaccgtt

SEQ ID NO: 8829 - DNA, 22 bp, Artificial Sequence
  Synthetic construct
gtgccccataggagcaccgttg

SEQ ID NO: 8830 - DNA, 22 bp, Artificial Sequence
  Synthetic construct
tgccccataggagcaccgttgg

SEQ ID NO: 8831 - DNA, 22 bp, Artificial Sequence
  Synthetic construct
gccccataggagcaccgttgga

SEQ ID NO: 8832 - DNA, 22 bp, Artificial Sequence
  Synthetic construct
ccccataggagcaccgttggag

SEQ ID NO: 8833 - DNA, 22 bp, Artificial Sequence
  Synthetic construct
cccataggagcaccgttggaga

SEQ ID NO: 8834 - DNA, 22 bp, Artificial Sequence
  Synthetic construct
ccataggagcaccgttggagaa

SEQ ID NO: 8835 - DNA, 22 bp, Artificial Sequence
  Synthetic construct
cataggagcaccgttggagaac

SEQ ID NO: 8836 - DNA, 22 bp, Artificial Sequence
  Synthetic construct
ataggagcaccgttggagaacg

SEQ ID NO: 8837 - DNA, 22 bp, Artificial Sequence
  Synthetic construct
taggagcaccgttggagaacgt

SEQ ID NO: 8838 - DNA, 22 bp, Artificial Sequence
  Synthetic construct
aggagcaccgttggagaacgtg

SEQ ID NO: 8839 - DNA, 22 bp, Artificial Sequence
  Synthetic construct
ggagcaccgttggagaacgtgc

SEQ ID NO: 8840 - DNA, 22 bp, Artificial Sequence
  Synthetic construct
gagcaccgttggagaacgtgca

SEQ ID NO: 8841 - DNA, 22 bp, Artificial Sequence
  Synthetic construct
agcaccgttggagaacgtgcat

SEQ ID NO: 8842 - DNA, 22 bp, Artificial Sequence
  Synthetic construct
gcaccgttggagaacgtgcatt

SEQ ID NO: 8843 - DNA, 22 bp, Artificial Sequence
  Synthetic construct
caccgttggagaacgtgcattg

SEQ ID NO: 8844 - DNA, 22 bp, Artificial Sequence
  Synthetic construct
accgttggagaacgtgcattgc

SEQ ID NO: 8845 - DNA, 22 bp, Artificial Sequence
  Synthetic construct
ccgttggagaacgtgcattgcc

SEQ ID NO: 8846 - DNA, 22 bp, Artificial Sequence
  Synthetic construct
cgttggagaacgtgcattgccc

SEQ ID NO: 8847 - DNA, 22 bp, Artificial Sequence
  Synthetic construct
gttggagaacgtgcattgccca

SEQ ID NO: 8848 - DNA, 22 bp, Artificial Sequence
  Synthetic construct
ttggagaacgtgcattgcccaa

SEQ ID NO: 8849 - DNA, 22 bp, Artificial Sequence
  Synthetic construct
tggagaacgtgcattgcccaaa

SEQ ID NO: 8850 - DNA, 22 bp, Artificial Sequence
  Synthetic construct
ggagaacgtgcattgcccaaac

SEQ ID NO: 8851 - DNA, 22 bp, Artificial Sequence
  Synthetic construct
gagaacgtgcattgcccaaaca

SEQ ID NO: 8852 - DNA, 22 bp, Artificial Sequence
  Synthetic construct
agaacgtgcattgcccaaacaa

SEQ ID NO: 8853 - DNA, 22 bp, Artificial Sequence
  Synthetic construct
gaacgtgcattgcccaaacaac

SEQ ID NO: 8854 - DNA, 22 bp, Artificial Sequence
  Synthetic construct
aacgtgcattgcccaaacaacg

SEQ ID NO: 8855 - DNA, 22 bp, Artificial Sequence
  Synthetic construct
acgtgcattgcccaaacaacga

SEQ ID NO: 8856 - DNA, 22 bp, Artificial Sequence
  Synthetic construct
cgtgcattgcccaaacaacgac

SEQ ID NO: 8857 - DNA, 22 bp, Artificial Sequence
  Synthetic construct
gtgcattgcccaaacaacgacg

SEQ ID NO: 8858 - DNA, 22 bp, Artificial Sequence
  Synthetic construct
tgcattgcccaaacaacgacga

SEQ ID NO: 8859 - DNA, 22 bp, Artificial Sequence
  Synthetic construct
gcattgcccaaacaacgacgat

SEQ ID NO: 8860 - DNA, 22 bp, Artificial Sequence
  Synthetic construct
cattgcccaaacaacgacgatc

SEQ ID NO: 8861 - DNA, 22 bp, Artificial Sequence
  Synthetic construct
attgcccaaacaacgacgatcg

SEQ ID NO: 8862 - DNA, 22 bp, Artificial Sequence
  Synthetic construct
ttgcccaaacaacgacgatcgg

SEQ ID NO: 8863 - DNA, 22 bp, Artificial Sequence
  Synthetic construct
tgcccaaacaacgacgatcggt

SEQ ID NO: 8864 - DNA, 22 bp, Artificial Sequence
  Synthetic construct
gcccaaacaacgacgatcggta

SEQ ID NO: 8865 - DNA, 22 bp, Artificial Sequence
  Synthetic construct
cccaaacaacgacgatcggtag

SEQ ID NO: 8866 - DNA, 22 bp, Artificial Sequence
  Synthetic construct
ccaaacaacgacgatcggtagc

SEQ ID NO: 8867 - DNA, 22 bp, Artificial Sequence
  Synthetic construct
caaacaacgacgatcggtagcc

SEQ ID NO: 8868 - DNA, 22 bp, Artificial Sequence
  Synthetic construct
aaacaacgacgatcggtagcca

SEQ ID NO: 8869 - DNA, 22 bp, Artificial Sequence
  Synthetic construct
aacaacgacgatcggtagccag

SEQ ID NO: 8870 - DNA, 22 bp, Artificial Sequence
  Synthetic construct
acaacgacgatcggtagccaga

SEQ ID NO: 8871 - DNA, 22 bp, Artificial Sequence
  Synthetic construct
caacgacgatcggtagccagag

SEQ ID NO: 8872 - DNA, 22 bp, Artificial Sequence
  Synthetic construct
aacgacgatcggtagccagaga

SEQ ID NO: 8873 - DNA, 22 bp, Artificial Sequence
  Synthetic construct
acgacgatcggtagccagagag

SEQ ID NO: 8874 - DNA, 22 bp, Artificial Sequence
  Synthetic construct
cgacgatcggtagccagagagg

SEQ ID NO: 8875 - DNA, 22 bp, Artificial Sequence
  Synthetic construct
gacgatcggtagccagagagga

SEQ ID NO: 8876 - DNA, 22 bp, Artificial Sequence
  Synthetic construct
acgatcggtagccagagaggag

SEQ ID NO: 8877 - DNA, 22 bp, Artificial Sequence
  Synthetic construct
cgatcggtagccagagaggagg

SEQ ID NO: 8878 - DNA, 22 bp, Artificial Sequence
  Synthetic construct
gatcggtagccagagaggaggt

SEQ ID NO: 8879 - DNA, 22 bp, Artificial Sequence
  Synthetic construct
atcggtagccagagaggaggtt

SEQ ID NO: 8880 - DNA, 22 bp, Artificial Sequence
  Synthetic construct
tcggtagccagagaggaggttg

SEQ ID NO: 8881 - DNA, 22 bp, Artificial Sequence
  Synthetic construct
cggtagccagagaggaggttgc

SEQ ID NO: 8882 - DNA, 22 bp, Artificial Sequence
  Synthetic construct
ggtagccagagaggaggttgcc

SEQ ID NO: 8883 - DNA, 22 bp, Artificial Sequence
  Synthetic construct
gtagccagagaggaggttgcca

SEQ ID NO: 8884 - DNA, 22 bp, Artificial Sequence
  Synthetic construct
tagccagagaggaggttgccaa

SEQ ID NO: 8885 - DNA, 22 bp, Artificial Sequence
  Synthetic construct
agccagagaggaggttgccaat

SEQ ID NO: 8886 - DNA, 22 bp, Artificial Sequence
  Synthetic construct
gccagagaggaggttgccaata

SEQ ID NO: 8887 - DNA, 22 bp, Artificial Sequence
  Synthetic construct
ccagagaggaggttgccaataa

SEQ ID NO: 8888 - DNA, 22 bp, Artificial Sequence
  Synthetic construct
cagagaggaggttgccaataag

SEQ ID NO: 8889 - DNA, 22 bp, Artificial Sequence
  Synthetic construct
agagaggaggttgccaataagg

SEQ ID NO: 8890 - DNA, 22 bp, Artificial Sequence
  Synthetic construct
gagaggaggttgccaataaggc

SEQ ID NO: 8891 - DNA, 22 bp, Artificial Sequence
  Synthetic construct
agaggaggttgccaataaggct

SEQ ID NO: 8892 - DNA, 22 bp, Artificial Sequence
  Synthetic construct
gaggaggttgccaataaggcta

SEQ ID NO: 8893 - DNA, 22 bp, Artificial Sequence
  Synthetic construct
aggaggttgccaataaggctac

SEQ ID NO: 8894 - DNA, 22 bp, Artificial Sequence
  Synthetic construct
ggaggttgccaataaggctacg

SEQ ID NO: 8895 - DNA, 22 bp, Artificial Sequence
  Synthetic construct
gaggttgccaataaggctacgg

SEQ ID NO: 8896 - DNA, 22 bp, Artificial Sequence
  Synthetic construct
aggttgccaataaggctacgga

SEQ ID NO: 8897 - DNA, 22 bp, Artificial Sequence
  Synthetic construct
ggttgccaataaggctacggat

SEQ ID NO: 8898 - DNA, 22 bp, Artificial Sequence
  Synthetic construct
gttgccaataaggctacggatg

SEQ ID NO: 8899 - DNA, 22 bp, Artificial Sequence
  Synthetic construct
ttgccaataaggctacggatgc

SEQ ID NO: 8900 - DNA, 22 bp, Artificial Sequence
  Synthetic construct
tgccaataaggctacggatgct

SEQ ID NO: 8901 - DNA, 22 bp, Artificial Sequence
  Synthetic construct
gccaataaggctacggatgctg

SEQ ID NO: 8902 - DNA, 22 bp, Artificial Sequence
  Synthetic construct
ccaataaggctacggatgctgg

SEQ ID NO: 8903 - DNA, 22 bp, Artificial Sequence
  Synthetic construct
caataaggctacggatgctggt

SEQ ID NO: 8904 - DNA, 22 bp, Artificial Sequence
  Synthetic construct
aataaggctacggatgctggtt

SEQ ID NO: 8905 - DNA, 22 bp, Artificial Sequence
  Synthetic construct
ataaggctacggatgctggttt

SEQ ID NO: 8906 - DNA, 22 bp, Artificial Sequence
  Synthetic construct
taaggctacggatgctggtttg

SEQ ID NO: 8907 - DNA, 22 bp, Artificial Sequence
  Synthetic construct
aaggctacggatgctggtttgt

SEQ ID NO: 8908 - DNA, 22 bp, Artificial Sequence
  Synthetic construct
aggctacggatgctggtttgta

SEQ ID NO: 8909 - DNA, 22 bp, Artificial Sequence
  Synthetic construct
ggctacggatgctggtttgtaa

SEQ ID NO: 8910 - DNA, 22 bp, Artificial Sequence
  Synthetic construct
gctacggatgctggtttgtaaa

SEQ ID NO: 8911 - DNA, 22 bp, Artificial Sequence
  Synthetic construct
ctacggatgctggtttgtaaaa

SEQ ID NO: 8912 - DNA, 22 bp, Artificial Sequence
  Synthetic construct
tacggatgctggtttgtaaaac

SEQ ID NO: 8913 - DNA, 22 bp, Artificial Sequence
  Synthetic construct
acggatgctggtttgtaaaaca

SEQ ID NO: 8914 - DNA, 22 bp, Artificial Sequence
  Synthetic construct
cggatgctggtttgtaaaacat

SEQ ID NO: 8915 - DNA, 22 bp, Artificial Sequence
  Synthetic construct
ggatgctggtttgtaaaacatc

SEQ ID NO: 8916 - DNA, 22 bp, Artificial Sequence
  Synthetic construct
gatgctggtttgtaaaacatcc

SEQ ID NO: 8917 - DNA, 22 bp, Artificial Sequence
  Synthetic construct
atgctggtttgtaaaacatccg

SEQ ID NO: 8918 - DNA, 22 bp, Artificial Sequence
  Synthetic construct
tgctggtttgtaaaacatccgg

SEQ ID NO: 8919 - DNA, 22 bp, Artificial Sequence
  Synthetic construct
gctggtttgtaaaacatccgga

SEQ ID NO: 8920 - DNA, 22 bp, Artificial Sequence
  Synthetic construct
ctggtttgtaaaacatccggat

SEQ ID NO: 8921 - DNA, 22 bp, Artificial Sequence
  Synthetic construct
tggtttgtaaaacatccggatc

SEQ ID NO: 8922 - DNA, 22 bp, Artificial Sequence
  Synthetic construct
ggtttgtaaaacatccggatcc

SEQ ID NO: 8923 - DNA, 22 bp, Artificial Sequence
  Synthetic construct
gtttgtaaaacatccggatccc

SEQ ID NO: 8924 - DNA, 22 bp, Artificial Sequence
  Synthetic construct
tttgtaaaacatccggatccca

SEQ ID NO: 8925 - DNA, 22 bp, Artificial Sequence
  Synthetic construct
ttgtaaaacatccggatcccat

SEQ ID NO: 8926 - DNA, 22 bp, Artificial Sequence
  Synthetic construct
tgtaaaacatccggatcccatg

SEQ ID NO: 8927 - DNA, 22 bp, Artificial Sequence
  Synthetic construct
gtaaaacatccggatcccatga

SEQ ID NO: 8928 - DNA, 22 bp, Artificial Sequence
  Synthetic construct
taaaacatccggatcccatgac

SEQ ID NO: 8929 - DNA, 22 bp, Artificial Sequence
  Synthetic construct
aaaacatccggatcccatgaca

SEQ ID NO: 8930 - DNA, 22 bp, Artificial Sequence
  Synthetic construct
aaacatccggatcccatgacaa

SEQ ID NO: 8931 - DNA, 22 bp, Artificial Sequence
  Synthetic construct
aacatccggatcccatgacaag

SEQ ID NO: 8932 - DNA, 22 bp, Artificial Sequence
  Synthetic construct
acatccggatcccatgacaagg

SEQ ID NO: 8933 - DNA, 22 bp, Artificial Sequence
  Synthetic construct
catccggatcccatgacaagga

SEQ ID NO: 8934 - DNA, 22 bp, Artificial Sequence
  Synthetic construct
atccggatcccatgacaaggat

SEQ ID NO: 8935 - DNA, 22 bp, Artificial Sequence
  Synthetic construct
tccggatcccatgacaaggatt

SEQ ID NO: 8936 - DNA, 22 bp, Artificial Sequence
  Synthetic construct
ccggatcccatgacaaggattt

SEQ ID NO: 8937 - DNA, 22 bp, Artificial Sequence
  Synthetic construct
cggatcccatgacaaggatttg

SEQ ID NO: 8938 - DNA, 22 bp, Artificial Sequence
  Synthetic construct
ggatcccatgacaaggatttgt

SEQ ID NO: 8939 - DNA, 22 bp, Artificial Sequence
  Synthetic construct
gatcccatgacaaggatttgtc

SEQ ID NO: 8940 - DNA, 22 bp, Artificial Sequence
  Synthetic construct
atcccatgacaaggatttgtca

SEQ ID NO: 8941 - DNA, 22 bp, Artificial Sequence
  Synthetic construct
tcccatgacaaggatttgtcat

SEQ ID NO: 8942 - DNA, 22 bp, Artificial Sequence
  Synthetic construct
cccatgacaaggatttgtcatg

SEQ ID NO: 8943 - DNA, 22 bp, Artificial Sequence
  Synthetic construct
ccatgacaaggatttgtcatgt

SEQ ID NO: 8944 - DNA, 22 bp, Artificial Sequence
  Synthetic construct
catgacaaggatttgtcatgta

SEQ ID NO: 8945 - DNA, 22 bp, Artificial Sequence
  Synthetic construct
atgacaaggatttgtcatgtaa

SEQ ID NO: 8946 - DNA, 22 bp, Artificial Sequence
  Synthetic construct
tgacaaggatttgtcatgtaag

SEQ ID NO: 8947 - DNA, 22 bp, Artificial Sequence
  Synthetic construct
gacaaggatttgtcatgtaaga

SEQ ID NO: 8948 - DNA, 22 bp, Artificial Sequence
  Synthetic construct
acaaggatttgtcatgtaagaa

SEQ ID NO: 8949 - DNA, 22 bp, Artificial Sequence
  Synthetic construct
caaggatttgtcatgtaagaaa

SEQ ID NO: 8950 - DNA, 22 bp, Artificial Sequence
  Synthetic construct
aaggatttgtcatgtaagaaac

SEQ ID NO: 8951 - DNA, 22 bp, Artificial Sequence
  Synthetic construct
aggatttgtcatgtaagaaacc

SEQ ID NO: 8952 - DNA, 22 bp, Artificial Sequence
  Synthetic construct
ggatttgtcatgtaagaaacct

SEQ ID NO: 8953 - DNA, 22 bp, Artificial Sequence
  Synthetic construct
gatttgtcatgtaagaaacctt

SEQ ID NO: 8954 - DNA, 22 bp, Artificial Sequence
  Synthetic construct
atttgtcatgtaagaaaccttc

SEQ ID NO: 8955 - DNA, 22 bp, Artificial Sequence
  Synthetic construct
tttgtcatgtaagaaaccttct

SEQ ID NO: 8956 - DNA, 22 bp, Artificial Sequence
  Synthetic construct
ttgtcatgtaagaaaccttctc

SEQ ID NO: 8957 - DNA, 22 bp, Artificial Sequence
  Synthetic construct
tgtcatgtaagaaaccttctct

SEQ ID NO: 8958 - DNA, 22 bp, Artificial Sequence
  Synthetic construct
gtcatgtaagaaaccttctcta

SEQ ID NO: 8959 - DNA, 22 bp, Artificial Sequence
  Synthetic construct
tcatgtaagaaaccttctctat

SEQ ID NO: 8960 - DNA, 22 bp, Artificial Sequence
  Synthetic construct
catgtaagaaaccttctctatt

SEQ ID NO: 8961 - DNA, 22 bp, Artificial Sequence
  Synthetic construct
atgtaagaaaccttctctattt

SEQ ID NO: 8962 - DNA, 22 bp, Artificial Sequence
  Synthetic construct
tgtaagaaaccttctctattta

SEQ ID NO: 8963 - DNA, 22 bp, Artificial Sequence
  Synthetic construct
gtaagaaaccttctctatttat

SEQ ID NO: 8964 - DNA, 22 bp, Artificial Sequence
  Synthetic construct
taagaaaccttctctatttatc

SEQ ID NO: 8965 - DNA, 22 bp, Artificial Sequence
  Synthetic construct
aagaaaccttctctatttatct

SEQ ID NO: 8966 - DNA, 22 bp, Artificial Sequence
  Synthetic construct
agaaaccttctctatttatctg

SEQ ID NO: 8967 - DNA, 22 bp, Artificial Sequence
  Synthetic construct
gaaaccttctctatttatctga

SEQ ID NO: 8968 - DNA, 22 bp, Artificial Sequence
  Synthetic construct
aaaccttctctatttatctgac

SEQ ID NO: 8969 - DNA, 22 bp, Artificial Sequence
  Synthetic construct
aaccttctctatttatctgacc

SEQ ID NO: 8970 - DNA, 22 bp, Artificial Sequence
  Synthetic construct
accttctctatttatctgaccg

SEQ ID NO: 8971 - DNA, 22 bp, Artificial Sequence
  Synthetic construct
ccttctctatttatctgaccgc

SEQ ID NO: 8972 - DNA, 22 bp, Artificial Sequence
  Synthetic construct
cttctctatttatctgaccgcg

SEQ ID NO: 8973 - DNA, 22 bp, Artificial Sequence
  Synthetic construct
ttctctatttatctgaccgcga

SEQ ID NO: 8974 - DNA, 22 bp, Artificial Sequence
  Synthetic construct
tctctatttatctgaccgcgat

SEQ ID NO: 8975 - DNA, 22 bp, Artificial Sequence
  Synthetic construct
ctctatttatctgaccgcgatc

SEQ ID NO: 8976 - DNA, 22 bp, Artificial Sequence
  Synthetic construct
tctatttatctgaccgcgatca

SEQ ID NO: 8977 - DNA, 22 bp, Artificial Sequence
  Synthetic construct
ctatttatctgaccgcgatcac

SEQ ID NO: 8978 - DNA, 22 bp, Artificial Sequence
  Synthetic construct
tatttatctgaccgcgatcacc

SEQ ID NO: 8979 - DNA, 22 bp, Artificial Sequence
  Synthetic construct
atttatctgaccgcgatcacca

SEQ ID NO: 8980 - DNA, 22 bp, Artificial Sequence
  Synthetic construct
tttatctgaccgcgatcaccat

SEQ ID NO: 8981 - DNA, 22 bp, Artificial Sequence
  Synthetic construct
ttatctgaccgcgatcaccatt

SEQ ID NO: 8982 - DNA, 22 bp, Artificial Sequence
  Synthetic construct
tatctgaccgcgatcaccattc

SEQ ID NO: 8983 - DNA, 22 bp, Artificial Sequence
  Synthetic construct
atctgaccgcgatcaccattcg

SEQ ID NO: 8984 - DNA, 22 bp, Artificial Sequence
  Synthetic construct
tctgaccgcgatcaccattcgc

SEQ ID NO: 8985 - DNA, 22 bp, Artificial Sequence
  Synthetic construct
ctgaccgcgatcaccattcgcc

SEQ ID NO: 8986 - DNA, 22 bp, Artificial Sequence
  Synthetic construct
tgaccgcgatcaccattcgcct

SEQ ID NO: 8987 - DNA, 22 bp, Artificial Sequence
  Synthetic construct
gaccgcgatcaccattcgcctc

SEQ ID NO: 8988 - DNA, 22 bp, Artificial Sequence
  Synthetic construct
accgcgatcaccattcgcctcc

SEQ ID NO: 8989 - DNA, 22 bp, Artificial Sequence
  Synthetic construct
ccgcgatcaccattcgcctccc

SEQ ID NO: 8990 - DNA, 22 bp, Artificial Sequence
  Synthetic construct
cgcgatcaccattcgcctcccg

SEQ ID NO: 8991 - DNA, 22 bp, Artificial Sequence
  Synthetic construct
gcgatcaccattcgcctcccgt

SEQ ID NO: 8992 - DNA, 22 bp, Artificial Sequence
  Synthetic construct
cgatcaccattcgcctcccgta

SEQ ID NO: 8993 - DNA, 22 bp, Artificial Sequence
  Synthetic construct
gatcaccattcgcctcccgtag

SEQ ID NO: 8994 - DNA, 22 bp, Artificial Sequence
  Synthetic construct
atcaccattcgcctcccgtagc

SEQ ID NO: 8995 - DNA, 22 bp, Artificial Sequence
  Synthetic construct
tcaccattcgcctcccgtagct

SEQ ID NO: 8996 - DNA, 22 bp, Artificial Sequence
  Synthetic construct
caccattcgcctcccgtagctt

SEQ ID NO: 8997 - DNA, 22 bp, Artificial Sequence
  Synthetic construct
accattcgcctcccgtagctta

SEQ ID NO: 8998 - DNA, 22 bp, Artificial Sequence
  Synthetic construct
ccattcgcctcccgtagcttag

SEQ ID NO: 8999 - DNA, 22 bp, Artificial Sequence
  Synthetic construct
cattcgcctcccgtagcttagc

SEQ ID NO: 9000 - DNA, 22 bp, Artificial Sequence
  Synthetic construct
attcgcctcccgtagcttagcg

SEQ ID NO: 9001 - DNA, 22 bp, Artificial Sequence
  Synthetic construct
ttcgcctcccgtagcttagcga

SEQ ID NO: 9002 - DNA, 22 bp, Artificial Sequence
  Synthetic construct
tcgcctcccgtagcttagcgat

SEQ ID NO: 9003 - DNA, 22 bp, Artificial Sequence
  Synthetic construct
cgcctcccgtagcttagcgata

SEQ ID NO: 9004 - DNA, 22 bp, Artificial Sequence
  Synthetic construct
gcctcccgtagcttagcgatag

SEQ ID NO: 9005 - DNA, 22 bp, Artificial Sequence
  Synthetic construct
cctcccgtagcttagcgatagc

SEQ ID NO: 9006 - DNA, 22 bp, Artificial Sequence
  Synthetic construct
ctcccgtagcttagcgatagct

SEQ ID NO: 9007 - DNA, 22 bp, Artificial Sequence
  Synthetic construct
tcccgtagcttagcgatagcta

SEQ ID NO: 9008 - DNA, 22 bp, Artificial Sequence
  Synthetic construct
cccgtagcttagcgatagctaa

SEQ ID NO: 9009 - DNA, 22 bp, Artificial Sequence
  Synthetic construct
ccgtagcttagcgatagctaag

SEQ ID NO: 9010 - DNA, 22 bp, Artificial Sequence
  Synthetic construct
cgtagcttagcgatagctaagg

SEQ ID NO: 9011 - DNA, 22 bp, Artificial Sequence
  Synthetic construct
gtagcttagcgatagctaaggt

SEQ ID NO: 9012 - DNA, 22 bp, Artificial Sequence
  Synthetic construct
tagcttagcgatagctaaggta

SEQ ID NO: 9013 - DNA, 22 bp, Artificial Sequence
  Synthetic construct
agcttagcgatagctaaggtac

SEQ ID NO: 9014 - DNA, 22 bp, Artificial Sequence
  Synthetic construct
gcttagcgatagctaaggtacg

SEQ ID NO: 9015 - DNA, 22 bp, Artificial Sequence
  Synthetic construct
cttagcgatagctaaggtacga

SEQ ID NO: 9016 - DNA, 22 bp, Artificial Sequence
  Synthetic construct
ttagcgatagctaaggtacgac

SEQ ID NO: 9017 - DNA, 22 bp, Artificial Sequence
  Synthetic construct
tagcgatagctaaggtacgacg

SEQ ID NO: 9018 - DNA, 22 bp, Artificial Sequence
  Synthetic construct
agcgatagctaaggtacgacgg

SEQ ID NO: 9019 - DNA, 22 bp, Artificial Sequence
  Synthetic construct
gcgatagctaaggtacgacggg

SEQ ID NO: 9020 - DNA, 22 bp, Artificial Sequence
  Synthetic construct
cgatagctaaggtacgacgggt

SEQ ID NO: 9021 - DNA, 22 bp, Artificial Sequence
  Synthetic construct
gatagctaaggtacgacgggtc

SEQ ID NO: 9022 - DNA, 22 bp, Artificial Sequence
  Synthetic construct
atagctaaggtacgacgggtcg

SEQ ID NO: 9023 - DNA, 22 bp, Artificial Sequence
  Synthetic construct
tagctaaggtacgacgggtcgc

SEQ ID NO: 9024 - DNA, 22 bp, Artificial Sequence
  Synthetic construct
agctaaggtacgacgggtcgcc

SEQ ID NO: 9025 - DNA, 22 bp, Artificial Sequence
  Synthetic construct
gctaaggtacgacgggtcgcct

SEQ ID NO: 9026 - DNA, 22 bp, Artificial Sequence
  Synthetic construct
ctaaggtacgacgggtcgcctc

SEQ ID NO: 9027 - DNA, 22 bp, Artificial Sequence
  Synthetic construct
taaggtacgacgggtcgcctcg

SEQ ID NO: 9028 - DNA, 22 bp, Artificial Sequence
  Synthetic construct
aaggtacgacgggtcgcctcgt

SEQ ID NO: 9029 - DNA, 22 bp, Artificial Sequence
  Synthetic construct
aggtacgacgggtcgcctcgtc

SEQ ID NO: 9030 - DNA, 22 bp, Artificial Sequence
  Synthetic construct
ggtacgacgggtcgcctcgtca

SEQ ID NO: 9031 - DNA, 22 bp, Artificial Sequence
  Synthetic construct
gtacgacgggtcgcctcgtcat

SEQ ID NO: 9032 - DNA, 22 bp, Artificial Sequence
  Synthetic construct
tacgacgggtcgcctcgtcatt

SEQ ID NO: 9033 - DNA, 22 bp, Artificial Sequence
  Synthetic construct
acgacgggtcgcctcgtcatta

SEQ ID NO: 9034 - DNA, 22 bp, Artificial Sequence
  Synthetic construct
cgacgggtcgcctcgtcattac

SEQ ID NO: 9035 - DNA, 22 bp, Artificial Sequence
  Synthetic construct
gacgggtcgcctcgtcattacc

SEQ ID NO: 9036 - DNA, 22 bp, Artificial Sequence
  Synthetic construct
acgggtcgcctcgtcattacca

SEQ ID NO: 9037 - DNA, 22 bp, Artificial Sequence
  Synthetic construct
cgggtcgcctcgtcattaccag

SEQ ID NO: 9038 - DNA, 22 bp, Artificial Sequence
  Synthetic construct
gggtcgcctcgtcattaccaga

SEQ ID NO: 9039 - DNA, 22 bp, Artificial Sequence
  Synthetic construct
ggtcgcctcgtcattaccagaa

SEQ ID NO: 9040 - DNA, 22 bp, Artificial Sequence
  Synthetic construct
gtcgcctcgtcattaccagaac

SEQ ID NO: 9041 - DNA, 22 bp, Artificial Sequence
  Synthetic construct
tcgcctcgtcattaccagaacc

SEQ ID NO: 9042 - DNA, 22 bp, Artificial Sequence
  Synthetic construct
cgcctcgtcattaccagaacct

SEQ ID NO: 9043 - DNA, 22 bp, Artificial Sequence
  Synthetic construct
gcctcgtcattaccagaaccta

SEQ ID NO: 9044 - DNA, 22 bp, Artificial Sequence
  Synthetic construct
cctcgtcattaccagaacctaa

SEQ ID NO: 9045 - DNA, 22 bp, Artificial Sequence
  Synthetic construct
ctcgtcattaccagaacctaag

SEQ ID NO: 9046 - DNA, 22 bp, Artificial Sequence
  Synthetic construct
tcgtcattaccagaacctaagg

SEQ ID NO: 9047 - DNA, 22 bp, Artificial Sequence
  Synthetic construct
cgtcattaccagaacctaaggt

SEQ ID NO: 9048 - DNA, 22 bp, Artificial Sequence
  Synthetic construct
gtcattaccagaacctaaggtc

SEQ ID NO: 9049 - DNA, 22 bp, Artificial Sequence
  Synthetic construct
tcattaccagaacctaaggtcg

SEQ ID NO: 9050 - DNA, 22 bp, Artificial Sequence
  Synthetic construct
cattaccagaacctaaggtcgg

SEQ ID NO: 9051 - DNA, 22 bp, Artificial Sequence
  Synthetic construct
attaccagaacctaaggtcgga

SEQ ID NO: 9052 - DNA, 22 bp, Artificial Sequence
  Synthetic construct
ttaccagaacctaaggtcggat

SEQ ID NO: 9053 - DNA, 22 bp, Artificial Sequence
  Synthetic construct
taccagaacctaaggtcggatg

SEQ ID NO: 9054 - DNA, 22 bp, Artificial Sequence
  Synthetic construct
accagaacctaaggtcggatgc

SEQ ID NO: 9055 - DNA, 22 bp, Artificial Sequence
  Synthetic construct
ccagaacctaaggtcggatgct

SEQ ID NO: 9056 - DNA, 22 bp, Artificial Sequence
  Synthetic construct
cagaacctaaggtcggatgctt

SEQ ID NO: 9057 - DNA, 22 bp, Artificial Sequence
  Synthetic construct
agaacctaaggtcggatgcttt

SEQ ID NO: 9058 - DNA, 22 bp, Artificial Sequence
  Synthetic construct
gaacctaaggtcggatgctttg

SEQ ID NO: 9059 - DNA, 22 bp, Artificial Sequence
  Synthetic construct
aacctaaggtcggatgctttgt

SEQ ID NO: 9060 - DNA, 22 bp, Artificial Sequence
  Synthetic construct
acctaaggtcggatgctttgtg

SEQ ID NO: 9061 - DNA, 22 bp, Artificial Sequence
  Synthetic construct
cctaaggtcggatgctttgtga

SEQ ID NO: 9062 - DNA, 22 bp, Artificial Sequence
  Synthetic construct
ctaaggtcggatgctttgtgag

SEQ ID NO: 9063 - DNA, 22 bp, Artificial Sequence
  Synthetic construct
taaggtcggatgctttgtgagc

SEQ ID NO: 9064 - DNA, 22 bp, Artificial Sequence
  Synthetic construct
aaggtcggatgctttgtgagca

SEQ ID NO: 9065 - DNA, 22 bp, Artificial Sequence
  Synthetic construct
aggtcggatgctttgtgagcaa

SEQ ID NO: 9066 - DNA, 22 bp, Artificial Sequence
  Synthetic construct
ggtcggatgctttgtgagcaat

SEQ ID NO: 9067 - DNA, 22 bp, Artificial Sequence
  Synthetic construct
gtcggatgctttgtgagcaatt

SEQ ID NO: 9068 - DNA, 22 bp, Artificial Sequence
  Synthetic construct
tcggatgctttgtgagcaattc

SEQ ID NO: 9069 - DNA, 22 bp, Artificial Sequence
  Synthetic construct
cggatgctttgtgagcaattcg

SEQ ID NO: 9070 - DNA, 22 bp, Artificial Sequence
  Synthetic construct
ggatgctttgtgagcaattcgt

SEQ ID NO: 9071 - DNA, 22 bp, Artificial Sequence
  Synthetic construct
gatgctttgtgagcaattcgtc

SEQ ID NO: 9072 - DNA, 22 bp, Artificial Sequence
  Synthetic construct
atgctttgtgagcaattcgtcc

SEQ ID NO: 9073 - DNA, 22 bp, Artificial Sequence
  Synthetic construct
tgctttgtgagcaattcgtccc

SEQ ID NO: 9074 - DNA, 22 bp, Artificial Sequence
  Synthetic construct
gctttgtgagcaattcgtccct

SEQ ID NO: 9075 - DNA, 22 bp, Artificial Sequence
  Synthetic construct
ctttgtgagcaattcgtccctt

SEQ ID NO: 9076 - DNA, 22 bp, Artificial Sequence
  Synthetic construct
tttgtgagcaattcgtccctta

SEQ ID NO: 9077 - DNA, 22 bp, Artificial Sequence
  Synthetic construct
ttgtgagcaattcgtcccttaa

SEQ ID NO: 9078 - DNA, 22 bp, Artificial Sequence
  Synthetic construct
tgtgagcaattcgtcccttaag

SEQ ID NO: 9079 - DNA, 22 bp, Artificial Sequence
  Synthetic construct
gtgagcaattcgtcccttaagt

SEQ ID NO: 9080 - DNA, 22 bp, Artificial Sequence
  Synthetic construct
tgagcaattcgtcccttaagta

SEQ ID NO: 9081 - DNA, 22 bp, Artificial Sequence
  Synthetic construct
gagcaattcgtcccttaagtaa

SEQ ID NO: 9082 - DNA, 22 bp, Artificial Sequence
  Synthetic construct
agcaattcgtcccttaagtaag

SEQ ID NO: 9083 - DNA, 22 bp, Artificial Sequence
  Synthetic construct
gcaattcgtcccttaagtaagc

SEQ ID NO: 9084 - DNA, 22 bp, Artificial Sequence
  Synthetic construct
caattcgtcccttaagtaagca

SEQ ID NO: 9085 - DNA, 22 bp, Artificial Sequence
  Synthetic construct
aattcgtcccttaagtaagcaa

SEQ ID NO: 9086 - DNA, 22 bp, Artificial Sequence
  Synthetic construct
attcgtcccttaagtaagcaat

SEQ ID NO: 9087 - DNA, 22 bp, Artificial Sequence
  Synthetic construct
ttcgtcccttaagtaagcaatt

SEQ ID NO: 9088 - DNA, 22 bp, Artificial Sequence
  Synthetic construct
tcgtcccttaagtaagcaattg

SEQ ID NO: 9089 - DNA, 22 bp, Artificial Sequence
  Synthetic construct
cgtcccttaagtaagcaattgc

SEQ ID NO: 9090 - DNA, 22 bp, Artificial Sequence
  Synthetic construct
gtcccttaagtaagcaattgct

SEQ ID NO: 9091 - DNA, 22 bp, Artificial Sequence
  Synthetic construct
tcccttaagtaagcaattgctg

SEQ ID NO: 9092 - DNA, 22 bp, Artificial Sequence
  Synthetic construct
cccttaagtaagcaattgctgt

SEQ ID NO: 9093 - DNA, 22 bp, Artificial Sequence
  Synthetic construct
ccttaagtaagcaattgctgta

SEQ ID NO: 9094 - DNA, 22 bp, Artificial Sequence
  Synthetic construct
cttaagtaagcaattgctgtaa

SEQ ID NO: 9095 - DNA, 22 bp, Artificial Sequence
  Synthetic construct
ttaagtaagcaattgctgtaaa

SEQ ID NO: 9096 - DNA, 22 bp, Artificial Sequence
  Synthetic construct
taagtaagcaattgctgtaaag

SEQ ID NO: 9097 - DNA, 22 bp, Artificial Sequence
  Synthetic construct
aagtaagcaattgctgtaaagt

SEQ ID NO: 9098 - DNA, 22 bp, Artificial Sequence
  Synthetic construct
agtaagcaattgctgtaaagtc

SEQ ID NO: 9099 - DNA, 22 bp, Artificial Sequence
  Synthetic construct
gtaagcaattgctgtaaagtcg

SEQ ID NO: 9100 - DNA, 22 bp, Artificial Sequence
  Synthetic construct
taagcaattgctgtaaagtcgt

SEQ ID NO: 9101 - DNA, 22 bp, Artificial Sequence
  Synthetic construct
aagcaattgctgtaaagtcgtc

SEQ ID NO: 9102 - DNA, 22 bp, Artificial Sequence
  Synthetic construct
agcaattgctgtaaagtcgtca

SEQ ID NO: 9103 - DNA, 22 bp, Artificial Sequence
  Synthetic construct
gcaattgctgtaaagtcgtcac

SEQ ID NO: 9104 - DNA, 22 bp, Artificial Sequence
  Synthetic construct
caattgctgtaaagtcgtcact

SEQ ID NO: 9105 - DNA, 22 bp, Artificial Sequence
  Synthetic construct
aattgctgtaaagtcgtcactg

SEQ ID NO: 9106 - DNA, 22 bp, Artificial Sequence
  Synthetic construct
attgctgtaaagtcgtcactgt

SEQ ID NO: 9107 - DNA, 22 bp, Artificial Sequence
  Synthetic construct
ttgctgtaaagtcgtcactgtg

SEQ ID NO: 9108 - DNA, 22 bp, Artificial Sequence
  Synthetic construct
tgctgtaaagtcgtcactgtgc

SEQ ID NO: 9109 - DNA, 22 bp, Artificial Sequence
  Synthetic construct
gctgtaaagtcgtcactgtgcg

SEQ ID NO: 9110 - DNA, 22 bp, Artificial Sequence
  Synthetic construct
ctgtaaagtcgtcactgtgcgg

SEQ ID NO: 9111 - DNA, 22 bp, Artificial Sequence
  Synthetic construct
tgtaaagtcgtcactgtgcgga

SEQ ID NO: 9112 - DNA, 22 bp, Artificial Sequence
  Synthetic construct
gtaaagtcgtcactgtgcggat

SEQ ID NO: 9113 - DNA, 22 bp, Artificial Sequence
  Synthetic construct
taaagtcgtcactgtgcggatc

SEQ ID NO: 9114 - DNA, 22 bp, Artificial Sequence
  Synthetic construct
aaagtcgtcactgtgcggatca

SEQ ID NO: 9115 - DNA, 22 bp, Artificial Sequence
  Synthetic construct
aagtcgtcactgtgcggatcac

SEQ ID NO: 9116 - DNA, 22 bp, Artificial Sequence
  Synthetic construct
agtcgtcactgtgcggatcacc

SEQ ID NO: 9117 - DNA, 22 bp, Artificial Sequence
  Synthetic construct
gtcgtcactgtgcggatcaccg

SEQ ID NO: 9118 - DNA, 22 bp, Artificial Sequence
  Synthetic construct
tcgtcactgtgcggatcaccgc

SEQ ID NO: 9119 - DNA, 22 bp, Artificial Sequence
  Synthetic construct
cgtcactgtgcggatcaccgct

SEQ ID NO: 9120 - DNA, 22 bp, Artificial Sequence
  Synthetic construct
gtcactgtgcggatcaccgctt

SEQ ID NO: 9121 - DNA, 22 bp, Artificial Sequence
  Synthetic construct
tcactgtgcggatcaccgcttc

SEQ ID NO: 9122 - DNA, 22 bp, Artificial Sequence
  Synthetic construct
cactgtgcggatcaccgcttcc

SEQ ID NO: 9123 - DNA, 22 bp, Artificial Sequence
  Synthetic construct
actgtgcggatcaccgcttcca

SEQ ID NO: 9124 - DNA, 22 bp, Artificial Sequence
  Synthetic construct
ctgtgcggatcaccgcttccag

SEQ ID NO: 9125 - DNA, 22 bp, Artificial Sequence
  Synthetic construct
tgtgcggatcaccgcttccagt

SEQ ID NO: 9126 - DNA, 22 bp, Artificial Sequence
  Synthetic construct
gtgcggatcaccgcttccagta

SEQ ID NO: 9127 - DNA, 22 bp, Artificial Sequence
  Synthetic construct
tgcggatcaccgcttccagtag

SEQ ID NO: 9128 - DNA, 22 bp, Artificial Sequence
  Synthetic construct
gcggatcaccgcttccagtagc

SEQ ID NO: 9129 - DNA, 22 bp, Artificial Sequence
  Synthetic construct
cggatcaccgcttccagtagcg

SEQ ID NO: 9130 - DNA, 22 bp, Artificial Sequence
  Synthetic construct
ggatcaccgcttccagtagcga

SEQ ID NO: 9131 - DNA, 22 bp, Artificial Sequence
  Synthetic construct
gatcaccgcttccagtagcgac

SEQ ID NO: 9132 - DNA, 22 bp, Artificial Sequence
  Synthetic construct
atcaccgcttccagtagcgaca

SEQ ID NO: 9133 - DNA, 22 bp, Artificial Sequence
  Synthetic construct
tcaccgcttccagtagcgacag

SEQ ID NO: 9134 - DNA, 22 bp, Artificial Sequence
  Synthetic construct
caccgcttccagtagcgacaga

SEQ ID NO: 9135 - DNA, 22 bp, Artificial Sequence
  Synthetic construct
accgcttccagtagcgacagaa

SEQ ID NO: 9136 - DNA, 22 bp, Artificial Sequence
  Synthetic construct
ccgcttccagtagcgacagaag

SEQ ID NO: 9137 - DNA, 22 bp, Artificial Sequence
  Synthetic construct
cgcttccagtagcgacagaagc

SEQ ID NO: 9138 - DNA, 22 bp, Artificial Sequence
  Synthetic construct
gcttccagtagcgacagaagca

SEQ ID NO: 9139 - DNA, 22 bp, Artificial Sequence
  Synthetic construct
cttccagtagcgacagaagcaa

SEQ ID NO: 9140 - DNA, 22 bp, Artificial Sequence
  Synthetic construct
ttccagtagcgacagaagcaat

SEQ ID NO: 9141 - DNA, 22 bp, Artificial Sequence
  Synthetic construct
tccagtagcgacagaagcaatt

SEQ ID NO: 9142 - DNA, 22 bp, Artificial Sequence
  Synthetic construct
ccagtagcgacagaagcaattg

SEQ ID NO: 9143 - DNA, 22 bp, Artificial Sequence
  Synthetic construct
cagtagcgacagaagcaattga

SEQ ID NO: 9144 - DNA, 22 bp, Artificial Sequence
  Synthetic construct
agtagcgacagaagcaattgat

SEQ ID NO: 9145 - DNA, 22 bp, Artificial Sequence
  Synthetic construct
gtagcgacagaagcaattgatt

SEQ ID NO: 9146 - DNA, 22 bp, Artificial Sequence
  Synthetic construct
tagcgacagaagcaattgattg

SEQ ID NO: 9147 - DNA, 22 bp, Artificial Sequence
  Synthetic construct
agcgacagaagcaattgattgg

SEQ ID NO: 9148 - DNA, 22 bp, Artificial Sequence
  Synthetic construct
gcgacagaagcaattgattggt

SEQ ID NO: 9149 - DNA, 22 bp, Artificial Sequence
  Synthetic construct
cgacagaagcaattgattggta

SEQ ID NO: 9150 - DNA, 22 bp, Artificial Sequence
  Synthetic construct
gacagaagcaattgattggtaa

SEQ ID NO: 9151 - DNA, 22 bp, Artificial Sequence
  Synthetic construct
acagaagcaattgattggtaaa

SEQ ID NO: 9152 - DNA, 22 bp, Artificial Sequence
  Synthetic construct
cagaagcaattgattggtaaat

SEQ ID NO: 9153 - DNA, 22 bp, Artificial Sequence
  Synthetic construct
agaagcaattgattggtaaatt

SEQ ID NO: 9154 - DNA, 22 bp, Artificial Sequence
  Synthetic construct
gaagcaattgattggtaaattt

SEQ ID NO: 9155 - DNA, 22 bp, Artificial Sequence
  Synthetic construct
aagcaattgattggtaaatttc

SEQ ID NO: 9156 - DNA, 22 bp, Artificial Sequence
  Synthetic construct
agcaattgattggtaaatttcg

SEQ ID NO: 9157 - DNA, 22 bp, Artificial Sequence
  Synthetic construct
gcaattgattggtaaatttcga

SEQ ID NO: 9158 - DNA, 22 bp, Artificial Sequence
  Synthetic construct
caattgattggtaaatttcgag

SEQ ID NO: 9159 - DNA, 22 bp, Artificial Sequence
  Synthetic construct
aattgattggtaaatttcgaga

SEQ ID NO: 9160 - DNA, 22 bp, Artificial Sequence
  Synthetic construct
attgattggtaaatttcgagag

SEQ ID NO: 9161 - DNA, 22 bp, Artificial Sequence
  Synthetic construct
ttgattggtaaatttcgagaga

SEQ ID NO: 9162 - DNA, 22 bp, Artificial Sequence
  Synthetic construct
tgattggtaaatttcgagagaa

SEQ ID NO: 9163 - DNA, 22 bp, Artificial Sequence
  Synthetic construct
gattggtaaatttcgagagaaa

SEQ ID NO: 9164 - DNA, 22 bp, Artificial Sequence
  Synthetic construct
attggtaaatttcgagagaaag

SEQ ID NO: 9165 - DNA, 22 bp, Artificial Sequence
  Synthetic construct
ttggtaaatttcgagagaaaga

SEQ ID NO: 9166 - DNA, 22 bp, Artificial Sequence
  Synthetic construct
tggtaaatttcgagagaaagat

SEQ ID NO: 9167 - DNA, 22 bp, Artificial Sequence
  Synthetic construct
ggtaaatttcgagagaaagatc

SEQ ID NO: 9168 - DNA, 22 bp, Artificial Sequence
  Synthetic construct
gtaaatttcgagagaaagatcg

SEQ ID NO: 9169 - DNA, 22 bp, Artificial Sequence
  Synthetic construct
taaatttcgagagaaagatcgc

SEQ ID NO: 9170 - DNA, 22 bp, Artificial Sequence
  Synthetic construct
aaatttcgagagaaagatcgcg

SEQ ID NO: 9171 - DNA, 22 bp, Artificial Sequence
  Synthetic construct
aatttcgagagaaagatcgcga

SEQ ID NO: 9172 - DNA, 22 bp, Artificial Sequence
  Synthetic construct
atttcgagagaaagatcgcgag

SEQ ID NO: 9173 - DNA, 22 bp, Artificial Sequence
  Synthetic construct
tttcgagagaaagatcgcgagg

SEQ ID NO: 9174 - DNA, 22 bp, Artificial Sequence
  Synthetic construct
ttcgagagaaagatcgcgagga

SEQ ID NO: 9175 - DNA, 22 bp, Artificial Sequence
  Synthetic construct
tcgagagaaagatcgcgaggaa

SEQ ID NO: 9176 - DNA, 22 bp, Artificial Sequence
  Synthetic construct
cgagagaaagatcgcgaggaag

SEQ ID NO: 9177 - DNA, 22 bp, Artificial Sequence
  Synthetic construct
gagagaaagatcgcgaggaaga

SEQ ID NO: 9178 - DNA, 22 bp, Artificial Sequence
  Synthetic construct
agagaaagatcgcgaggaagat

SEQ ID NO: 9179 - DNA, 22 bp, Artificial Sequence
  Synthetic construct
gagaaagatcgcgaggaagatc

SEQ ID NO: 9180 - DNA, 22 bp, Artificial Sequence
  Synthetic construct
agaaagatcgcgaggaagatca

SEQ ID NO: 9181 - DNA, 22 bp, Artificial Sequence
  Synthetic construct
gaaagatcgcgaggaagatcaa

SEQ ID NO: 9182 - DNA, 22 bp, Artificial Sequence
  Synthetic construct
aaagatcgcgaggaagatcaat

SEQ ID NO: 9183 - DNA, 22 bp, Artificial Sequence
  Synthetic construct
aagatcgcgaggaagatcaata

SEQ ID NO: 9184 - DNA, 22 bp, Artificial Sequence
  Synthetic construct
agatcgcgaggaagatcaatac

SEQ ID NO: 9185 - DNA, 22 bp, Artificial Sequence
  Synthetic construct
gatcgcgaggaagatcaataca

SEQ ID NO: 9186 - DNA, 22 bp, Artificial Sequence
  Synthetic construct
atcgcgaggaagatcaatacat

SEQ ID NO: 9187 - DNA, 22 bp, Artificial Sequence
  Synthetic construct
tcgcgaggaagatcaatacata

SEQ ID NO: 9188 - DNA, 22 bp, Artificial Sequence
  Synthetic construct
cgcgaggaagatcaatacataa

SEQ ID NO: 9189 - DNA, 22 bp, Artificial Sequence
  Synthetic construct
gcgaggaagatcaatacataaa

SEQ ID NO: 9190 - DNA, 22 bp, Artificial Sequence
  Synthetic construct
cgaggaagatcaatacataaag

SEQ ID NO: 9191 - DNA, 22 bp, Artificial Sequence
  Synthetic construct
gaggaagatcaatacataaaga

SEQ ID NO: 9192 - DNA, 22 bp, Artificial Sequence
  Synthetic construct
aggaagatcaatacataaagag

SEQ ID NO: 9193 - DNA, 22 bp, Artificial Sequence
  Synthetic construct
ggaagatcaatacataaagagt

SEQ ID NO: 9194 - DNA, 22 bp, Artificial Sequence
  Synthetic construct
gaagatcaatacataaagagtt

SEQ ID NO: 9195 - DNA, 22 bp, Artificial Sequence
  Synthetic construct
aagatcaatacataaagagttg

SEQ ID NO: 9196 - DNA, 22 bp, Artificial Sequence
  Synthetic construct
agatcaatacataaagagttga

SEQ ID NO: 9197 - DNA, 22 bp, Artificial Sequence
  Synthetic construct
gatcaatacataaagagttgaa

SEQ ID NO: 9198 - DNA, 22 bp, Artificial Sequence
  Synthetic construct
atcaatacataaagagttgaac

SEQ ID NO: 9199 - DNA, 22 bp, Artificial Sequence
  Synthetic construct
tcaatacataaagagttgaact

SEQ ID NO: 9200 - DNA, 22 bp, Artificial Sequence
  Synthetic construct
caatacataaagagttgaactt

SEQ ID NO: 9201 - DNA, 22 bp, Artificial Sequence
  Synthetic construct
aatacataaagagttgaacttc

SEQ ID NO: 9202 - DNA, 22 bp, Artificial Sequence
  Synthetic construct
atacataaagagttgaacttct

SEQ ID NO: 9203 - DNA, 22 bp, Artificial Sequence
  Synthetic construct
tacataaagagttgaacttctt

SEQ ID NO: 9204 - DNA, 22 bp, Artificial Sequence
  Synthetic construct
acataaagagttgaacttcttt

SEQ ID NO: 9205 - DNA, 22 bp, Artificial Sequence
  Synthetic construct
cataaagagttgaacttctttg

SEQ ID NO: 9206 - DNA, 22 bp, Artificial Sequence
  Synthetic construct
ataaagagttgaacttctttgt

SEQ ID NO: 9207 - DNA, 22 bp, Artificial Sequence
  Synthetic construct
taaagagttgaacttctttgtt

SEQ ID NO: 9208 - DNA, 22 bp, Artificial Sequence
  Synthetic construct
aaagagttgaacttctttgttg

SEQ ID NO: 9209 - DNA, 22 bp, Artificial Sequence
  Synthetic construct
aagagttgaacttctttgttgt

SEQ ID NO: 9210 - DNA, 22 bp, Artificial Sequence
  Synthetic construct
agagttgaacttctttgttgtc

SEQ ID NO: 9211 - DNA, 22 bp, Artificial Sequence
  Synthetic construct
gagttgaacttctttgttgtct

SEQ ID NO: 9212 - DNA, 22 bp, Artificial Sequence
  Synthetic construct
agttgaacttctttgttgtctt

SEQ ID NO: 9213 - DNA, 22 bp, Artificial Sequence
  Synthetic construct
gttgaacttctttgttgtcttc

SEQ ID NO: 9214 - DNA, 22 bp, Artificial Sequence
  Synthetic construct
ttgaacttctttgttgtcttcg

SEQ ID NO: 9215 - DNA, 22 bp, Artificial Sequence
  Synthetic construct
tgaacttctttgttgtcttcga

SEQ ID NO: 9216 - DNA, 22 bp, Artificial Sequence
  Synthetic construct
gaacttctttgttgtcttcgac

SEQ ID NO: 9217 - DNA, 22 bp, Artificial Sequence
  Synthetic construct
aacttctttgttgtcttcgaca

SEQ ID NO: 9218 - DNA, 22 bp, Artificial Sequence
  Synthetic construct
acttctttgttgtcttcgacat

SEQ ID NO: 9219 - DNA, 22 bp, Artificial Sequence
  Synthetic construct
cttctttgttgtcttcgacatg

SEQ ID NO: 9220 - DNA, 22 bp, Artificial Sequence
  Synthetic construct
ttctttgttgtcttcgacatgg

SEQ ID NO: 9221 - DNA, 22 bp, Artificial Sequence
  Synthetic construct
tctttgttgtcttcgacatggg

SEQ ID NO: 9222 - DNA, 22 bp, Artificial Sequence
  Synthetic construct
ctttgttgtcttcgacatgggt

SEQ ID NO: 9223 - DNA, 22 bp, Artificial Sequence
  Synthetic construct
tttgttgtcttcgacatgggta

SEQ ID NO: 9224 - DNA, 22 bp, Artificial Sequence
  Synthetic construct
ttgttgtcttcgacatgggtaa

SEQ ID NO: 9225 - DNA, 22 bp, Artificial Sequence
  Synthetic construct
tgttgtcttcgacatgggtaat

SEQ ID NO: 9226 - DNA, 22 bp, Artificial Sequence
  Synthetic construct
gttgtcttcgacatgggtaatc

SEQ ID NO: 9227 - DNA, 22 bp, Artificial Sequence
  Synthetic construct
ttgtcttcgacatgggtaatcc

SEQ ID NO: 9228 - DNA, 22 bp, Artificial Sequence
  Synthetic construct
tgtcttcgacatgggtaatcct

SEQ ID NO: 9229 - DNA, 22 bp, Artificial Sequence
  Synthetic construct
gtcttcgacatgggtaatcctc

SEQ ID NO: 9230 - DNA, 22 bp, Artificial Sequence
  Synthetic construct
tcttcgacatgggtaatcctca

SEQ ID NO: 9231 - DNA, 22 bp, Artificial Sequence
  Synthetic construct
cttcgacatgggtaatcctcat

SEQ ID NO: 9232 - DNA, 22 bp, Artificial Sequence
  Synthetic construct
ttcgacatgggtaatcctcatg

SEQ ID NO: 9233 - DNA, 22 bp, Artificial Sequence
  Synthetic construct
tcgacatgggtaatcctcatgt

SEQ ID NO: 9234 - DNA, 22 bp, Artificial Sequence
  Synthetic construct
cgacatgggtaatcctcatgtt

SEQ ID NO: 9235 - DNA, 22 bp, Artificial Sequence
  Synthetic construct
gacatgggtaatcctcatgttt

SEQ ID NO: 9236 - DNA, 22 bp, Artificial Sequence
  Synthetic construct
acatgggtaatcctcatgtttg

SEQ ID NO: 9237 - DNA, 22 bp, Artificial Sequence
  Synthetic construct
catgggtaatcctcatgtttga

SEQ ID NO: 9238 - DNA, 22 bp, Artificial Sequence
  Synthetic construct
atgggtaatcctcatgtttgaa

SEQ ID NO: 9239 - DNA, 22 bp, Artificial Sequence
  Synthetic construct
tgggtaatcctcatgtttgaat

SEQ ID NO: 9240 - DNA, 22 bp, Artificial Sequence
  Synthetic construct
gggtaatcctcatgtttgaatg

SEQ ID NO: 9241 - DNA, 22 bp, Artificial Sequence
  Synthetic construct
ggtaatcctcatgtttgaatgg

SEQ ID NO: 9242 - DNA, 22 bp, Artificial Sequence
  Synthetic construct
gtaatcctcatgtttgaatggc

SEQ ID NO: 9243 - DNA, 22 bp, Artificial Sequence
  Synthetic construct
taatcctcatgtttgaatggcc

SEQ ID NO: 9244 - DNA, 22 bp, Artificial Sequence
  Synthetic construct
aatcctcatgtttgaatggccg

SEQ ID NO: 9245 - DNA, 22 bp, Artificial Sequence
  Synthetic construct
atcctcatgtttgaatggccgg

SEQ ID NO: 9246 - DNA, 22 bp, Artificial Sequence
  Synthetic construct
tcctcatgtttgaatggccggc

SEQ ID NO: 9247 - DNA, 22 bp, Artificial Sequence
  Synthetic construct
cctcatgtttgaatggccggcg

SEQ ID NO: 9248 - DNA, 22 bp, Artificial Sequence
  Synthetic construct
ctcatgtttgaatggccggcgt

SEQ ID NO: 9249 - DNA, 22 bp, Artificial Sequence
  Synthetic construct
tcatgtttgaatggccggcgtc

SEQ ID NO: 9250 - DNA, 22 bp, Artificial Sequence
  Synthetic construct
catgtttgaatggccggcgtct

SEQ ID NO: 9251 - DNA, 22 bp, Artificial Sequence
  Synthetic construct
atgtttgaatggccggcgtcta

SEQ ID NO: 9252 - DNA, 22 bp, Artificial Sequence
  Synthetic construct
tgtttgaatggccggcgtctat

SEQ ID NO: 9253 - DNA, 22 bp, Artificial Sequence
  Synthetic construct
gtttgaatggccggcgtctatt

SEQ ID NO: 9254 - DNA, 22 bp, Artificial Sequence
  Synthetic construct
tttgaatggccggcgtctatta

SEQ ID NO: 9255 - DNA, 22 bp, Artificial Sequence
  Synthetic construct
ttgaatggccggcgtctattag

SEQ ID NO: 9256 - DNA, 22 bp, Artificial Sequence
  Synthetic construct
tgaatggccggcgtctattagt

SEQ ID NO: 9257 - DNA, 22 bp, Artificial Sequence
  Synthetic construct
gaatggccggcgtctattagta

SEQ ID NO: 9258 - DNA, 22 bp, Artificial Sequence
  Synthetic construct
aatggccggcgtctattagtag

SEQ ID NO: 9259 - DNA, 22 bp, Artificial Sequence
  Synthetic construct
atggccggcgtctattagtaga

SEQ ID NO: 9260 - DNA, 22 bp, Artificial Sequence
  Synthetic construct
tggccggcgtctattagtagat

SEQ ID NO: 9261 - DNA, 22 bp, Artificial Sequence
  Synthetic construct
ggccggcgtctattagtagatg

SEQ ID NO: 9262 - DNA, 22 bp, Artificial Sequence
  Synthetic construct
gccggcgtctattagtagatgc

SEQ ID NO: 9263 - DNA, 22 bp, Artificial Sequence
  Synthetic construct
ccggcgtctattagtagatgcc

SEQ ID NO: 9264 - DNA, 22 bp, Artificial Sequence
  Synthetic construct
cggcgtctattagtagatgccg

SEQ ID NO: 9265 - DNA, 22 bp, Artificial Sequence
  Synthetic construct
ggcgtctattagtagatgccgg

SEQ ID NO: 9266 - DNA, 22 bp, Artificial Sequence
  Synthetic construct
gcgtctattagtagatgccgga

SEQ ID NO: 9267 - DNA, 22 bp, Artificial Sequence
  Synthetic construct
cgtctattagtagatgccggag

SEQ ID NO: 9268 - DNA, 22 bp, Artificial Sequence
  Synthetic construct
gtctattagtagatgccggagt

SEQ ID NO: 9269 - DNA, 22 bp, Artificial Sequence
  Synthetic construct
tctattagtagatgccggagtt

SEQ ID NO: 9270 - DNA, 22 bp, Artificial Sequence
  Synthetic construct
ctattagtagatgccggagttt

SEQ ID NO: 9271 - DNA, 22 bp, Artificial Sequence
  Synthetic construct
tattagtagatgccggagtttg

SEQ ID NO: 9272 - DNA, 22 bp, Artificial Sequence
  Synthetic construct
attagtagatgccggagtttgc

SEQ ID NO: 9273 - DNA, 22 bp, Artificial Sequence
  Synthetic construct
ttagtagatgccggagtttgct

SEQ ID NO: 9274 - DNA, 22 bp, Artificial Sequence
  Synthetic construct
tagtagatgccggagtttgctg

SEQ ID NO: 9275 - DNA, 22 bp, Artificial Sequence
  Synthetic construct
agtagatgccggagtttgctgc

SEQ ID NO: 9276 - DNA, 22 bp, Artificial Sequence
  Synthetic construct
gtagatgccggagtttgctgcg

SEQ ID NO: 9277 - DNA, 22 bp, Artificial Sequence
  Synthetic construct
tagatgccggagtttgctgcga

SEQ ID NO: 9278 - DNA, 22 bp, Artificial Sequence
  Synthetic construct
agatgccggagtttgctgcgat

SEQ ID NO: 9279 - DNA, 22 bp, Artificial Sequence
  Synthetic construct
gatgccggagtttgctgcgatt

SEQ ID NO: 9280 - DNA, 22 bp, Artificial Sequence
  Synthetic construct
atgccggagtttgctgcgattg

SEQ ID NO: 9281 - DNA, 22 bp, Artificial Sequence
  Synthetic construct
tgccggagtttgctgcgattgc

SEQ ID NO: 9282 - DNA, 22 bp, Artificial Sequence
  Synthetic construct
gccggagtttgctgcgattgct

SEQ ID NO: 9283 - DNA, 22 bp, Artificial Sequence
  Synthetic construct
ccggagtttgctgcgattgctg

SEQ ID NO: 9284 - DNA, 22 bp, Artificial Sequence
  Synthetic construct
cggagtttgctgcgattgctga

SEQ ID NO: 9285 - DNA, 22 bp, Artificial Sequence
  Synthetic construct
ggagtttgctgcgattgctgag

SEQ ID NO: 9286 - DNA, 22 bp, Artificial Sequence
  Synthetic construct
gagtttgctgcgattgctgagg

SEQ ID NO: 9287 - DNA, 22 bp, Artificial Sequence
  Synthetic construct
agtttgctgcgattgctgaggg

SEQ ID NO: 9288 - DNA, 22 bp, Artificial Sequence
  Synthetic construct
gtttgctgcgattgctgaggga

SEQ ID NO: 9289 - DNA, 22 bp, Artificial Sequence
  Synthetic construct
tttgctgcgattgctgagggaa

SEQ ID NO: 9290 - DNA, 22 bp, Artificial Sequence
  Synthetic construct
ttgctgcgattgctgagggaat

SEQ ID NO: 9291 - DNA, 22 bp, Artificial Sequence
  Synthetic construct
tgctgcgattgctgagggaatc

SEQ ID NO: 9292 - DNA, 22 bp, Artificial Sequence
  Synthetic construct
gctgcgattgctgagggaatcg

SEQ ID NO: 9293 - DNA, 22 bp, Artificial Sequence
  Synthetic construct
ctgcgattgctgagggaatcgg

SEQ ID NO: 9294 - DNA, 22 bp, Artificial Sequence
  Synthetic construct
tgcgattgctgagggaatcggg

SEQ ID NO: 9295 - DNA, 22 bp, Artificial Sequence
  Synthetic construct
gcgattgctgagggaatcgggt

SEQ ID NO: 9296 - DNA, 22 bp, Artificial Sequence
  Synthetic construct
cgattgctgagggaatcgggtt

SEQ ID NO: 9297 - DNA, 22 bp, Artificial Sequence
  Synthetic construct
gattgctgagggaatcgggttt

SEQ ID NO: 9298 - DNA, 22 bp, Artificial Sequence
  Synthetic construct
attgctgagggaatcgggtttc

SEQ ID NO: 9299 - DNA, 22 bp, Artificial Sequence
  Synthetic construct
ttgctgagggaatcgggtttcc

SEQ ID NO: 9300 - DNA, 22 bp, Artificial Sequence
  Synthetic construct
tgctgagggaatcgggtttcca

SEQ ID NO: 9301 - DNA, 22 bp, Artificial Sequence
  Synthetic construct
gctgagggaatcgggtttccat

SEQ ID NO: 9302 - DNA, 22 bp, Artificial Sequence
  Synthetic construct
ctgagggaatcgggtttccatc

SEQ ID NO: 9303 - DNA, 22 bp, Artificial Sequence
  Synthetic construct
tgagggaatcgggtttccatct

SEQ ID NO: 9304 - DNA, 22 bp, Artificial Sequence
  Synthetic construct
gagggaatcgggtttccatctt

SEQ ID NO: 9305 - DNA, 22 bp, Artificial Sequence
  Synthetic construct
agggaatcgggtttccatcttt

SEQ ID NO: 9306 - DNA, 22 bp, Artificial Sequence
  Synthetic construct
gggaatcgggtttccatctttt

SEQ ID NO: 9307 - DNA, 22 bp, Artificial Sequence
  Synthetic construct
ggaatcgggtttccatctttta

SEQ ID NO: 9308 - DNA, 22 bp, Artificial Sequence
  Synthetic construct
gaatcgggtttccatcttttag

SEQ ID NO: 9309 - DNA, 22 bp, Artificial Sequence
  Synthetic construct
aatcgggtttccatcttttagg

SEQ ID NO: 9310 - DNA, 22 bp, Artificial Sequence
  Synthetic construct
atcgggtttccatcttttagga

SEQ ID NO: 9311 - DNA, 22 bp, Artificial Sequence
  Synthetic construct
tcgggtttccatcttttaggag

SEQ ID NO: 9312 - DNA, 22 bp, Artificial Sequence
  Synthetic construct
cgggtttccatcttttaggaga

SEQ ID NO: 9313 - DNA, 22 bp, Artificial Sequence
  Synthetic construct
gggtttccatcttttaggagac

SEQ ID NO: 9314 - DNA, 22 bp, Artificial Sequence
  Synthetic construct
ggtttccatcttttaggagacc

SEQ ID NO: 9315 - DNA, 22 bp, Artificial Sequence
  Synthetic construct
gtttccatcttttaggagacct

SEQ ID NO: 9316 - DNA, 22 bp, Artificial Sequence
  Synthetic construct
tttccatcttttaggagacctt

SEQ ID NO: 9317 - DNA, 22 bp, Artificial Sequence
  Synthetic construct
ttccatcttttaggagaccttg

SEQ ID NO: 9318 - DNA, 22 bp, Artificial Sequence
  Synthetic construct
tccatcttttaggagaccttgc

SEQ ID NO: 9319 - DNA, 22 bp, Artificial Sequence
  Synthetic construct
ccatcttttaggagaccttgca

SEQ ID NO: 9320 - DNA, 22 bp, Artificial Sequence
  Synthetic construct
catcttttaggagaccttgcat

SEQ ID NO: 9321 - DNA, 22 bp, Artificial Sequence
  Synthetic construct
atcttttaggagaccttgcatt

SEQ ID NO: 9322 - DNA, 22 bp, Artificial Sequence
  Synthetic construct
tcttttaggagaccttgcattg

SEQ ID NO: 9323 - DNA, 22 bp, Artificial Sequence
  Synthetic construct
cttttaggagaccttgcattgc

SEQ ID NO: 9324 - DNA, 22 bp, Artificial Sequence
  Synthetic construct
ttttaggagaccttgcattgcc

SEQ ID NO: 9325 - DNA, 22 bp, Artificial Sequence
  Synthetic construct
tttaggagaccttgcattgcct

SEQ ID NO: 9326 - DNA, 22 bp, Artificial Sequence
  Synthetic construct
ttaggagaccttgcattgcctt

SEQ ID NO: 9327 - DNA, 22 bp, Artificial Sequence
  Synthetic construct
taggagaccttgcattgcctta

SEQ ID NO: 9328 - DNA, 22 bp, Artificial Sequence
  Synthetic construct
aggagaccttgcattgccttaa

SEQ ID NO: 9329 - DNA, 22 bp, Artificial Sequence
  Synthetic construct
ggagaccttgcattgccttaac

SEQ ID NO: 9330 - DNA, 22 bp, Artificial Sequence
  Synthetic construct
gagaccttgcattgccttaaca

SEQ ID NO: 9331 - DNA, 22 bp, Artificial Sequence
  Synthetic construct
agaccttgcattgccttaacaa

SEQ ID NO: 9332 - DNA, 22 bp, Artificial Sequence
  Synthetic construct
gaccttgcattgccttaacaat

SEQ ID NO: 9333 - DNA, 22 bp, Artificial Sequence
  Synthetic construct
accttgcattgccttaacaata

SEQ ID NO: 9334 - DNA, 22 bp, Artificial Sequence
  Synthetic construct
ccttgcattgccttaacaataa

SEQ ID NO: 9335 - DNA, 22 bp, Artificial Sequence
  Synthetic construct
cttgcattgccttaacaataag

SEQ ID NO: 9336 - DNA, 22 bp, Artificial Sequence
  Synthetic construct
ttgcattgccttaacaataagc

SEQ ID NO: 9337 - DNA, 22 bp, Artificial Sequence
  Synthetic construct
tgcattgccttaacaataagct

SEQ ID NO: 9338 - DNA, 22 bp, Artificial Sequence
  Synthetic construct
gcattgccttaacaataagctc

SEQ ID NO: 9339 - DNA, 22 bp, Artificial Sequence
  Synthetic construct
cattgccttaacaataagctcg

SEQ ID NO: 9340 - DNA, 22 bp, Artificial Sequence
  Synthetic construct
attgccttaacaataagctcgc

SEQ ID NO: 9341 - DNA, 22 bp, Artificial Sequence
  Synthetic construct
ttgccttaacaataagctcgca

SEQ ID NO: 9342 - DNA, 22 bp, Artificial Sequence
  Synthetic construct
tgccttaacaataagctcgcag

SEQ ID NO: 9343 - DNA, 22 bp, Artificial Sequence
  Synthetic construct
gccttaacaataagctcgcagt

SEQ ID NO: 9344 - DNA, 22 bp, Artificial Sequence
  Synthetic construct
ccttaacaataagctcgcagtc

SEQ ID NO: 9345 - DNA, 22 bp, Artificial Sequence
  Synthetic construct
cttaacaataagctcgcagtcg

SEQ ID NO: 9346 - DNA, 22 bp, Artificial Sequence
  Synthetic construct
ttaacaataagctcgcagtcgg

SEQ ID NO: 9347 - DNA, 22 bp, Artificial Sequence
  Synthetic construct
taacaataagctcgcagtcgga

SEQ ID NO: 9348 - DNA, 22 bp, Artificial Sequence
  Synthetic construct
aacaataagctcgcagtcggaa

SEQ ID NO: 9349 - DNA, 22 bp, Artificial Sequence
  Synthetic construct
acaataagctcgcagtcggaat

SEQ ID NO: 9350 - DNA, 22 bp, Artificial Sequence
  Synthetic construct
caataagctcgcagtcggaatt

SEQ ID NO: 9351 - DNA, 22 bp, Artificial Sequence
  Synthetic construct
aataagctcgcagtcggaattc

SEQ ID NO: 9352 - DNA, 22 bp, Artificial Sequence
  Synthetic construct
ataagctcgcagtcggaattcg

SEQ ID NO: 9353 - DNA, 22 bp, Artificial Sequence
  Synthetic construct
taagctcgcagtcggaattcgt

SEQ ID NO: 9354 - DNA, 22 bp, Artificial Sequence
  Synthetic construct
aagctcgcagtcggaattcgta

SEQ ID NO: 9355 - DNA, 22 bp, Artificial Sequence
  Synthetic construct
agctcgcagtcggaattcgtag

SEQ ID NO: 9356 - DNA, 22 bp, Artificial Sequence
  Synthetic construct
gctcgcagtcggaattcgtagc

SEQ ID NO: 9357 - DNA, 22 bp, Artificial Sequence
  Synthetic construct
ctcgcagtcggaattcgtagcg

SEQ ID NO: 9358 - DNA, 22 bp, Artificial Sequence
  Synthetic construct
tcgcagtcggaattcgtagcga

SEQ ID NO: 9359 - DNA, 22 bp, Artificial Sequence
  Synthetic construct
cgcagtcggaattcgtagcgaa

SEQ ID NO: 9360 - DNA, 22 bp, Artificial Sequence
  Synthetic construct
gcagtcggaattcgtagcgaaa

SEQ ID NO: 9361 - DNA, 22 bp, Artificial Sequence
  Synthetic construct
cagtcggaattcgtagcgaaaa

SEQ ID NO: 9362 - DNA, 22 bp, Artificial Sequence
  Synthetic construct
agtcggaattcgtagcgaaaat

SEQ ID NO: 9363 - DNA, 22 bp, Artificial Sequence
  Synthetic construct
gtcggaattcgtagcgaaaatt

SEQ ID NO: 9364 - DNA, 22 bp, Artificial Sequence
  Synthetic construct
tcggaattcgtagcgaaaattg

SEQ ID NO: 9365 - DNA, 22 bp, Artificial Sequence
  Synthetic construct
cggaattcgtagcgaaaattgg

SEQ ID NO: 9366 - DNA, 22 bp, Artificial Sequence
  Synthetic construct
ggaattcgtagcgaaaattgga

SEQ ID NO: 9367 - DNA, 22 bp, Artificial Sequence
  Synthetic construct
gaattcgtagcgaaaattggaa

SEQ ID NO: 9368 - DNA, 22 bp, Artificial Sequence
  Synthetic construct
aattcgtagcgaaaattggaat

SEQ ID NO: 9369 - DNA, 22 bp, Artificial Sequence
  Synthetic construct
attcgtagcgaaaattggaatg

SEQ ID NO: 9370 - DNA, 22 bp, Artificial Sequence
  Synthetic construct
ttcgtagcgaaaattggaatgg

SEQ ID NO: 9371 - DNA, 22 bp, Artificial Sequence
  Synthetic construct
tcgtagcgaaaattggaatggt

SEQ ID NO: 9372 - DNA, 22 bp, Artificial Sequence
  Synthetic construct
cgtagcgaaaattggaatggtt

SEQ ID NO: 9373 - DNA, 22 bp, Artificial Sequence
  Synthetic construct
gtagcgaaaattggaatggtta

SEQ ID NO: 9374 - DNA, 22 bp, Artificial Sequence
  Synthetic construct
tagcgaaaattggaatggttag

SEQ ID NO: 9375 - DNA, 22 bp, Artificial Sequence
  Synthetic construct
agcgaaaattggaatggttagt

SEQ ID NO: 9376 - DNA, 22 bp, Artificial Sequence
  Synthetic construct
gcgaaaattggaatggttagtt

SEQ ID NO: 9377 - DNA, 22 bp, Artificial Sequence
  Synthetic construct
cgaaaattggaatggttagttc

SEQ ID NO: 9378 - DNA, 22 bp, Artificial Sequence
  Synthetic construct
gaaaattggaatggttagttcc

SEQ ID NO: 9379 - DNA, 22 bp, Artificial Sequence
  Synthetic construct
aaaattggaatggttagttcca

SEQ ID NO: 9380 - DNA, 22 bp, Artificial Sequence
  Synthetic construct
aaattggaatggttagttccat

SEQ ID NO: 9381 - DNA, 22 bp, Artificial Sequence
  Synthetic construct
aattggaatggttagttccata

SEQ ID NO: 9382 - DNA, 22 bp, Artificial Sequence
  Synthetic construct
attggaatggttagttccatat

SEQ ID NO: 9383 - DNA, 22 bp, Artificial Sequence
  Synthetic construct
ttggaatggttagttccatatt

SEQ ID NO: 9384 - DNA, 22 bp, Artificial Sequence
  Synthetic construct
tggaatggttagttccatattt

SEQ ID NO: 9385 - DNA, 22 bp, Artificial Sequence
  Synthetic construct
ggaatggttagttccatattta

SEQ ID NO: 9386 - DNA, 22 bp, Artificial Sequence
  Synthetic construct
gaatggttagttccatatttaa

SEQ ID NO: 9387 - DNA, 22 bp, Artificial Sequence
  Synthetic construct
aatggttagttccatatttaag

SEQ ID NO: 9388 - DNA, 22 bp, Artificial Sequence
  Synthetic construct
atggttagttccatatttaagt

SEQ ID NO: 9389 - DNA, 22 bp, Artificial Sequence
  Synthetic construct
tggttagttccatatttaagta

SEQ ID NO: 9390 - DNA, 22 bp, Artificial Sequence
  Synthetic construct
ggttagttccatatttaagtac

SEQ ID NO: 9391 - DNA, 22 bp, Artificial Sequence
  Synthetic construct
gttagttccatatttaagtacg

SEQ ID NO: 9392 - DNA, 22 bp, Artificial Sequence
  Synthetic construct
ttagttccatatttaagtacga

SEQ ID NO: 9393 - DNA, 22 bp, Artificial Sequence
  Synthetic construct
tagttccatatttaagtacgaa

SEQ ID NO: 9394 - DNA, 22 bp, Artificial Sequence
  Synthetic construct
agttccatatttaagtacgaac

SEQ ID NO: 9395 - DNA, 22 bp, Artificial Sequence
  Synthetic construct
gttccatatttaagtacgaacg

SEQ ID NO: 9396 - DNA, 22 bp, Artificial Sequence
  Synthetic construct
ttccatatttaagtacgaacgc

SEQ ID NO: 9397 - DNA, 22 bp, Artificial Sequence
  Synthetic construct
tccatatttaagtacgaacgcc

SEQ ID NO: 9398 - DNA, 22 bp, Artificial Sequence
  Synthetic construct
ccatatttaagtacgaacgcca

SEQ ID NO: 9399 - DNA, 22 bp, Artificial Sequence
  Synthetic construct
catatttaagtacgaacgccat

SEQ ID NO: 9400 - DNA, 22 bp, Artificial Sequence
  Synthetic construct
atatttaagtacgaacgccatg

SEQ ID NO: 9401 - DNA, 22 bp, Artificial Sequence
  Synthetic construct
tatttaagtacgaacgccatgc

SEQ ID NO: 9402 - DNA, 22 bp, Artificial Sequence
  Synthetic construct
atttaagtacgaacgccatgcg

SEQ ID NO: 9403 - DNA, 22 bp, Artificial Sequence
  Synthetic construct
tttaagtacgaacgccatgcgg

SEQ ID NO: 9404 - DNA, 22 bp, Artificial Sequence
  Synthetic construct
ttaagtacgaacgccatgcggc

SEQ ID NO: 9405 - DNA, 22 bp, Artificial Sequence
  Synthetic construct
taagtacgaacgccatgcggct

SEQ ID NO: 9406 - DNA, 22 bp, Artificial Sequence
  Synthetic construct
aagtacgaacgccatgcggcta

SEQ ID NO: 9407 - DNA, 22 bp, Artificial Sequence
  Synthetic construct
agtacgaacgccatgcggctac

SEQ ID NO: 9408 - DNA, 22 bp, Artificial Sequence
  Synthetic construct
gtacgaacgccatgcggctaca

SEQ ID NO: 9409 - DNA, 22 bp, Artificial Sequence
  Synthetic construct
tacgaacgccatgcggctacag

SEQ ID NO: 9410 - DNA, 22 bp, Artificial Sequence
  Synthetic construct
acgaacgccatgcggctacagg

SEQ ID NO: 9411 - DNA, 22 bp, Artificial Sequence
  Synthetic construct
cgaacgccatgcggctacagga

SEQ ID NO: 9412 - DNA, 22 bp, Artificial Sequence
  Synthetic construct
gaacgccatgcggctacaggaa

SEQ ID NO: 9413 - DNA, 22 bp, Artificial Sequence
  Synthetic construct
aacgccatgcggctacaggaag

SEQ ID NO: 9414 - DNA, 22 bp, Artificial Sequence
  Synthetic construct
acgccatgcggctacaggaagc

SEQ ID NO: 9415 - DNA, 22 bp, Artificial Sequence
  Synthetic construct
cgccatgcggctacaggaagct

SEQ ID NO: 9416 - DNA, 22 bp, Artificial Sequence
  Synthetic construct
gccatgcggctacaggaagctc

SEQ ID NO: 9417 - DNA, 22 bp, Artificial Sequence
  Synthetic construct
ccatgcggctacaggaagctct

SEQ ID NO: 9418 - DNA, 22 bp, Artificial Sequence
  Synthetic construct
catgcggctacaggaagctcta

SEQ ID NO: 9419 - DNA, 22 bp, Artificial Sequence
  Synthetic construct
atgcggctacaggaagctctac

SEQ ID NO: 9420 - DNA, 22 bp, Artificial Sequence
  Synthetic construct
tgcggctacaggaagctctaca

SEQ ID NO: 9421 - DNA, 22 bp, Artificial Sequence
  Synthetic construct
gcggctacaggaagctctacac

SEQ ID NO: 9422 - DNA, 22 bp, Artificial Sequence
  Synthetic construct
cggctacaggaagctctacacc

SEQ ID NO: 9423 - DNA, 22 bp, Artificial Sequence
  Synthetic construct
ggctacaggaagctctacacca

SEQ ID NO: 9424 - DNA, 22 bp, Artificial Sequence
  Synthetic construct
gctacaggaagctctacaccac

SEQ ID NO: 9425 - DNA, 22 bp, Artificial Sequence
  Synthetic construct
ctacaggaagctctacaccacc

SEQ ID NO: 9426 - DNA, 22 bp, Artificial Sequence
  Synthetic construct
tacaggaagctctacaccacca

SEQ ID NO: 9427 - DNA, 22 bp, Artificial Sequence
  Synthetic construct
acaggaagctctacaccaccaa

SEQ ID NO: 9428 - DNA, 22 bp, Artificial Sequence
  Synthetic construct
caggaagctctacaccaccaac

SEQ ID NO: 9429 - DNA, 22 bp, Artificial Sequence
  Synthetic construct
aggaagctctacaccaccaaca

SEQ ID NO: 9430 - DNA, 22 bp, Artificial Sequence
  Synthetic construct
ggaagctctacaccaccaacag

SEQ ID NO: 9431 - DNA, 22 bp, Artificial Sequence
  Synthetic construct
gaagctctacaccaccaacagt

SEQ ID NO: 9432 - DNA, 22 bp, Artificial Sequence
  Synthetic construct
aagctctacaccaccaacagtc

SEQ ID NO: 9433 - DNA, 22 bp, Artificial Sequence
  Synthetic construct
agctctacaccaccaacagtct

SEQ ID NO: 9434 - DNA, 22 bp, Artificial Sequence
  Synthetic construct
gctctacaccaccaacagtctg

SEQ ID NO: 9435 - DNA, 22 bp, Artificial Sequence
  Synthetic construct
ctctacaccaccaacagtctgg

SEQ ID NO: 9436 - DNA, 22 bp, Artificial Sequence
  Synthetic construct
tctacaccaccaacagtctggg

SEQ ID NO: 9437 - DNA, 22 bp, Artificial Sequence
  Synthetic construct
ctacaccaccaacagtctgggt

SEQ ID NO: 9438 - DNA, 22 bp, Artificial Sequence
  Synthetic construct
tacaccaccaacagtctgggtt

SEQ ID NO: 9439 - DNA, 22 bp, Artificial Sequence
  Synthetic construct
acaccaccaacagtctgggttg

SEQ ID NO: 9440 - DNA, 22 bp, Artificial Sequence
  Synthetic construct
caccaccaacagtctgggttgc

SEQ ID NO: 9441 - DNA, 22 bp, Artificial Sequence
  Synthetic construct
accaccaacagtctgggttgcc

SEQ ID NO: 9442 - DNA, 22 bp, Artificial Sequence
  Synthetic construct
ccaccaacagtctgggttgcca

SEQ ID NO: 9443 - DNA, 22 bp, Artificial Sequence
  Synthetic construct
caccaacagtctgggttgccac

SEQ ID NO: 9444 - DNA, 22 bp, Artificial Sequence
  Synthetic construct
accaacagtctgggttgccact

SEQ ID NO: 9445 - DNA, 22 bp, Artificial Sequence
  Synthetic construct
ccaacagtctgggttgccactt

SEQ ID NO: 9446 - DNA, 22 bp, Artificial Sequence
  Synthetic construct
caacagtctgggttgccacttt

SEQ ID NO: 9447 - DNA, 22 bp, Artificial Sequence
  Synthetic construct
aacagtctgggttgccacttta

SEQ ID NO: 9448 - DNA, 22 bp, Artificial Sequence
  Synthetic construct
acagtctgggttgccactttag

SEQ ID NO: 9449 - DNA, 22 bp, Artificial Sequence
  Synthetic construct
cagtctgggttgccactttagg

SEQ ID NO: 9450 - DNA, 22 bp, Artificial Sequence
  Synthetic construct
agtctgggttgccactttaggc

SEQ ID NO: 9451 - DNA, 22 bp, Artificial Sequence
  Synthetic construct
gtctgggttgccactttaggca

SEQ ID NO: 9452 - DNA, 22 bp, Artificial Sequence
  Synthetic construct
tctgggttgccactttaggcac

SEQ ID NO: 9453 - DNA, 22 bp, Artificial Sequence
  Synthetic construct
ctgggttgccactttaggcacc

SEQ ID NO: 9454 - DNA, 22 bp, Artificial Sequence
  Synthetic construct
tgggttgccactttaggcacct

SEQ ID NO: 9455 - DNA, 22 bp, Artificial Sequence
  Synthetic construct
gggttgccactttaggcacctc

SEQ ID NO: 9456 - DNA, 22 bp, Artificial Sequence
  Synthetic construct
ggttgccactttaggcacctcg

SEQ ID NO: 9457 - DNA, 22 bp, Artificial Sequence
  Synthetic construct
gttgccactttaggcacctcga

SEQ ID NO: 9458 - DNA, 22 bp, Artificial Sequence
  Synthetic construct
ttgccactttaggcacctcgac

SEQ ID NO: 9459 - DNA, 22 bp, Artificial Sequence
  Synthetic construct
tgccactttaggcacctcgact

SEQ ID NO: 9460 - DNA, 22 bp, Artificial Sequence
  Synthetic construct
gccactttaggcacctcgactt

SEQ ID NO: 9461 - DNA, 22 bp, Artificial Sequence
  Synthetic construct
ccactttaggcacctcgacttt

SEQ ID NO: 9462 - DNA, 22 bp, Artificial Sequence
  Synthetic construct
cactttaggcacctcgactttg

SEQ ID NO: 9463 - DNA, 22 bp, Artificial Sequence
  Synthetic construct
actttaggcacctcgactttga

SEQ ID NO: 9464 - DNA, 22 bp, Artificial Sequence
  Synthetic construct
ctttaggcacctcgactttgat

SEQ ID NO: 9465 - DNA, 22 bp, Artificial Sequence
  Synthetic construct
tttaggcacctcgactttgatg

SEQ ID NO: 9466 - DNA, 22 bp, Artificial Sequence
  Synthetic construct
ttaggcacctcgactttgatgg

SEQ ID NO: 9467 - DNA, 22 bp, Artificial Sequence
  Synthetic construct
taggcacctcgactttgatggt

SEQ ID NO: 9468 - DNA, 22 bp, Artificial Sequence
  Synthetic construct
aggcacctcgactttgatggtg

SEQ ID NO: 9469 - DNA, 22 bp, Artificial Sequence
  Synthetic construct
ggcacctcgactttgatggtgt

SEQ ID NO: 9470 - DNA, 22 bp, Artificial Sequence
  Synthetic construct
gcacctcgactttgatggtgta

SEQ ID NO: 9471 - DNA, 22 bp, Artificial Sequence
  Synthetic construct
cacctcgactttgatggtgtat

SEQ ID NO: 9472 - DNA, 22 bp, Artificial Sequence
  Synthetic construct
acctcgactttgatggtgtatt

SEQ ID NO: 9473 - DNA, 22 bp, Artificial Sequence
  Synthetic construct
cctcgactttgatggtgtattt

SEQ ID NO: 9474 - DNA, 22 bp, Artificial Sequence
  Synthetic construct
ctcgactttgatggtgtatttg

SEQ ID NO: 9475 - DNA, 22 bp, Artificial Sequence
  Synthetic construct
tcgactttgatggtgtatttgc

SEQ ID NO: 9476 - DNA, 22 bp, Artificial Sequence
  Synthetic construct
cgactttgatggtgtatttgcg

SEQ ID NO: 9477 - DNA, 22 bp, Artificial Sequence
  Synthetic construct
gactttgatggtgtatttgcga

SEQ ID NO: 9478 - DNA, 22 bp, Artificial Sequence
  Synthetic construct
actttgatggtgtatttgcgat

SEQ ID NO: 9479 - DNA, 22 bp, Artificial Sequence
  Synthetic construct
ctttgatggtgtatttgcgatt

SEQ ID NO: 9480 - DNA, 22 bp, Artificial Sequence
  Synthetic construct
tttgatggtgtatttgcgattc

SEQ ID NO: 9481 - DNA, 22 bp, Artificial Sequence
  Synthetic construct
ttgatggtgtatttgcgattct

SEQ ID NO: 9482 - DNA, 22 bp, Artificial Sequence
  Synthetic construct
tgatggtgtatttgcgattctg

SEQ ID NO: 9483 - DNA, 22 bp, Artificial Sequence
  Synthetic construct
gatggtgtatttgcgattctgc

SEQ ID NO: 9484 - DNA, 22 bp, Artificial Sequence
  Synthetic construct
atggtgtatttgcgattctgcg

SEQ ID NO: 9485 - DNA, 22 bp, Artificial Sequence
  Synthetic construct
tggtgtatttgcgattctgcgc

SEQ ID NO: 9486 - DNA, 22 bp, Artificial Sequence
  Synthetic construct
ggtgtatttgcgattctgcgca

SEQ ID NO: 9487 - DNA, 22 bp, Artificial Sequence
  Synthetic construct
gtgtatttgcgattctgcgcag

SEQ ID NO: 9488 - DNA, 22 bp, Artificial Sequence
  Synthetic construct
tgtatttgcgattctgcgcaga

SEQ ID NO: 9489 - DNA, 22 bp, Artificial Sequence
  Synthetic construct
gtatttgcgattctgcgcagag

SEQ ID NO: 9490 - DNA, 22 bp, Artificial Sequence
  Synthetic construct
tatttgcgattctgcgcagagc

SEQ ID NO: 9491 - DNA, 22 bp, Artificial Sequence
  Synthetic construct
atttgcgattctgcgcagagct

SEQ ID NO: 9492 - DNA, 22 bp, Artificial Sequence
  Synthetic construct
tttgcgattctgcgcagagctc

SEQ ID NO: 9493 - DNA, 22 bp, Artificial Sequence
  Synthetic construct
ttgcgattctgcgcagagctct

SEQ ID NO: 9494 - DNA, 22 bp, Artificial Sequence
  Synthetic construct
tgcgattctgcgcagagctctg

SEQ ID NO: 9495 - DNA, 22 bp, Artificial Sequence
  Synthetic construct
gcgattctgcgcagagctctga

SEQ ID NO: 9496 - DNA, 22 bp, Artificial Sequence
  Synthetic construct
cgattctgcgcagagctctgac

SEQ ID NO: 9497 - DNA, 22 bp, Artificial Sequence
  Synthetic construct
gattctgcgcagagctctgacg

SEQ ID NO: 9498 - DNA, 22 bp, Artificial Sequence
  Synthetic construct
attctgcgcagagctctgacga

SEQ ID NO: 9499 - DNA, 22 bp, Artificial Sequence
  Synthetic construct
ttctgcgcagagctctgacgaa

SEQ ID NO: 9500 - DNA, 22 bp, Artificial Sequence
  Synthetic construct
tctgcgcagagctctgacgaac

SEQ ID NO: 9501 - DNA, 22 bp, Artificial Sequence
  Synthetic construct
ctgcgcagagctctgacgaacg

SEQ ID NO: 9502 - DNA, 22 bp, Artificial Sequence
  Synthetic construct
tgcgcagagctctgacgaacgc

SEQ ID NO: 9503 - DNA, 22 bp, Artificial Sequence
  Synthetic construct
gcgcagagctctgacgaacgct

SEQ ID NO: 9504 - DNA, 22 bp, Artificial Sequence
  Synthetic construct
cgcagagctctgacgaacgcta

SEQ ID NO: 9505 - DNA, 22 bp, Artificial Sequence
  Synthetic construct
gcagagctctgacgaacgctac

SEQ ID NO: 9506 - DNA, 22 bp, Artificial Sequence
  Synthetic construct
cagagctctgacgaacgctaca

SEQ ID NO: 9507 - DNA, 22 bp, Artificial Sequence
  Synthetic construct
agagctctgacgaacgctacag

SEQ ID NO: 9508 - DNA, 22 bp, Artificial Sequence
  Synthetic construct
gagctctgacgaacgctacagg

SEQ ID NO: 9509 - DNA, 22 bp, Artificial Sequence
  Synthetic construct
agctctgacgaacgctacaggt

SEQ ID NO: 9510 - DNA, 22 bp, Artificial Sequence
  Synthetic construct
gctctgacgaacgctacaggtt

SEQ ID NO: 9511 - DNA, 22 bp, Artificial Sequence
  Synthetic construct
ctctgacgaacgctacaggtta

SEQ ID NO: 9512 - DNA, 22 bp, Artificial Sequence
  Synthetic construct
tctgacgaacgctacaggttac

SEQ ID NO: 9513 - DNA, 22 bp, Artificial Sequence
  Synthetic construct
ctgacgaacgctacaggttact

SEQ ID NO: 9514 - DNA, 22 bp, Artificial Sequence
  Synthetic construct
tgacgaacgctacaggttactt

SEQ ID NO: 9515 - DNA, 22 bp, Artificial Sequence
  Synthetic construct
gacgaacgctacaggttacttt

SEQ ID NO: 9516 - DNA, 22 bp, Artificial Sequence
  Synthetic construct
acgaacgctacaggttactttg

SEQ ID NO: 9517 - DNA, 22 bp, Artificial Sequence
  Synthetic construct
cgaacgctacaggttactttgt

SEQ ID NO: 9518 - DNA, 22 bp, Artificial Sequence
  Synthetic construct
gaacgctacaggttactttgta

SEQ ID NO: 9519 - DNA, 22 bp, Artificial Sequence
  Synthetic construct
aacgctacaggttactttgtaa

SEQ ID NO: 9520 - DNA, 22 bp, Artificial Sequence
  Synthetic construct
acgctacaggttactttgtaag

SEQ ID NO: 9521 - DNA, 22 bp, Artificial Sequence
  Synthetic construct
cgctacaggttactttgtaagc

SEQ ID NO: 9522 - DNA, 22 bp, Artificial Sequence
  Synthetic construct
gctacaggttactttgtaagcc

SEQ ID NO: 9523 - DNA, 22 bp, Artificial Sequence
  Synthetic construct
ctacaggttactttgtaagcct

SEQ ID NO: 9524 - DNA, 22 bp, Artificial Sequence
  Synthetic construct
tacaggttactttgtaagcctg

SEQ ID NO: 9525 - DNA, 22 bp, Artificial Sequence
  Synthetic construct
acaggttactttgtaagcctgt

SEQ ID NO: 9526 - DNA, 22 bp, Artificial Sequence
  Synthetic construct
caggttactttgtaagcctgtg

SEQ ID NO: 9527 - DNA, 22 bp, Artificial Sequence
  Synthetic construct
aggttactttgtaagcctgtga

SEQ ID NO: 9528 - DNA, 22 bp, Artificial Sequence
  Synthetic construct
ggttactttgtaagcctgtgaa

SEQ ID NO: 9529 - DNA, 22 bp, Artificial Sequence
  Synthetic construct
gttactttgtaagcctgtgaac

SEQ ID NO: 9530 - DNA, 22 bp, Artificial Sequence
  Synthetic construct
ttactttgtaagcctgtgaacg

SEQ ID NO: 9531 - DNA, 22 bp, Artificial Sequence
  Synthetic construct
tactttgtaagcctgtgaacgc

SEQ ID NO: 9532 - DNA, 22 bp, Artificial Sequence
  Synthetic construct
actttgtaagcctgtgaacgcg

SEQ ID NO: 9533 - DNA, 22 bp, Artificial Sequence
  Synthetic construct
ctttgtaagcctgtgaacgcga

SEQ ID NO: 9534 - DNA, 22 bp, Artificial Sequence
  Synthetic construct
tttgtaagcctgtgaacgcgag

SEQ ID NO: 9535 - DNA, 22 bp, Artificial Sequence
  Synthetic construct
ttgtaagcctgtgaacgcgagt

SEQ ID NO: 9536 - DNA, 22 bp, Artificial Sequence
  Synthetic construct
tgtaagcctgtgaacgcgagtt

SEQ ID NO: 9537 - DNA, 22 bp, Artificial Sequence
  Synthetic construct
gtaagcctgtgaacgcgagtta

SEQ ID NO: 9538 - DNA, 22 bp, Artificial Sequence
  Synthetic construct
taagcctgtgaacgcgagttag

SEQ ID NO: 9539 - DNA, 22 bp, Artificial Sequence
  Synthetic construct
aagcctgtgaacgcgagttaga

SEQ ID NO: 9540 - DNA, 22 bp, Artificial Sequence
  Synthetic construct
agcctgtgaacgcgagttagag

SEQ ID NO: 9541 - DNA, 22 bp, Artificial Sequence
  Synthetic construct
gcctgtgaacgcgagttagagc

SEQ ID NO: 9542 - DNA, 22 bp, Artificial Sequence
  Synthetic construct
cctgtgaacgcgagttagagct

SEQ ID NO: 9543 - DNA, 22 bp, Artificial Sequence
  Synthetic construct
ctgtgaacgcgagttagagctg

SEQ ID NO: 9544 - DNA, 22 bp, Artificial Sequence
  Synthetic construct
tgtgaacgcgagttagagctga

SEQ ID NO: 9545 - DNA, 22 bp, Artificial Sequence
  Synthetic construct
gtgaacgcgagttagagctgat

SEQ ID NO: 9546 - DNA, 22 bp, Artificial Sequence
  Synthetic construct
tgaacgcgagttagagctgatc

SEQ ID NO: 9547 - DNA, 22 bp, Artificial Sequence
  Synthetic construct
gaacgcgagttagagctgatcc

SEQ ID NO: 9548 - DNA, 22 bp, Artificial Sequence
  Synthetic construct
aacgcgagttagagctgatcca

SEQ ID NO: 9549 - DNA, 22 bp, Artificial Sequence
  Synthetic construct
acgcgagttagagctgatccat

SEQ ID NO: 9550 - DNA, 22 bp, Artificial Sequence
  Synthetic construct
cgcgagttagagctgatccatt

SEQ ID NO: 9551 - DNA, 22 bp, Artificial Sequence
  Synthetic construct
gcgagttagagctgatccattc

SEQ ID NO: 9552 - DNA, 22 bp, Artificial Sequence
  Synthetic construct
cgagttagagctgatccattca

SEQ ID NO: 9553 - DNA, 22 bp, Artificial Sequence
  Synthetic construct
gagttagagctgatccattcag

SEQ ID NO: 9554 - DNA, 22 bp, Artificial Sequence
  Synthetic construct
agttagagctgatccattcagc

SEQ ID NO: 9555 - DNA, 22 bp, Artificial Sequence
  Synthetic construct
gttagagctgatccattcagcg

SEQ ID NO: 9556 - DNA, 22 bp, Artificial Sequence
  Synthetic construct
ttagagctgatccattcagcga

SEQ ID NO: 9557 - DNA, 22 bp, Artificial Sequence
  Synthetic construct
tagagctgatccattcagcgac

SEQ ID NO: 9558 - DNA, 22 bp, Artificial Sequence
  Synthetic construct
agagctgatccattcagcgacc

SEQ ID NO: 9559 - DNA, 22 bp, Artificial Sequence
  Synthetic construct
gagctgatccattcagcgaccc

SEQ ID NO: 9560 - DNA, 22 bp, Artificial Sequence
  Synthetic construct
agctgatccattcagcgacccc

SEQ ID NO: 9561 - DNA, 22 bp, Artificial Sequence
  Synthetic construct
gctgatccattcagcgaccccg

SEQ ID NO: 9562 - DNA, 22 bp, Artificial Sequence
  Synthetic construct
ctgatccattcagcgaccccgt

SEQ ID NO: 9563 - DNA, 22 bp, Artificial Sequence
  Synthetic construct
tgatccattcagcgaccccgtt

SEQ ID NO: 9564 - DNA, 22 bp, Artificial Sequence
  Synthetic construct
gatccattcagcgaccccgtta

SEQ ID NO: 9565 - DNA, 22 bp, Artificial Sequence
  Synthetic construct
atccattcagcgaccccgttag

SEQ ID NO: 9566 - DNA, 22 bp, Artificial Sequence
  Synthetic construct
tccattcagcgaccccgttagc

SEQ ID NO: 9567 - DNA, 22 bp, Artificial Sequence
  Synthetic construct
ccattcagcgaccccgttagcg

SEQ ID NO: 9568 - DNA, 22 bp, Artificial Sequence
  Synthetic construct
cattcagcgaccccgttagcga

SEQ ID NO: 9569 - DNA, 22 bp, Artificial Sequence
  Synthetic construct
attcagcgaccccgttagcgaa

SEQ ID NO: 9570 - DNA, 22 bp, Artificial Sequence
  Synthetic construct
ttcagcgaccccgttagcgaag

SEQ ID NO: 9571 - DNA, 22 bp, Artificial Sequence
  Synthetic construct
tcagcgaccccgttagcgaagt

SEQ ID NO: 9572 - DNA, 22 bp, Artificial Sequence
  Synthetic construct
cagcgaccccgttagcgaagtt

SEQ ID NO: 9573 - DNA, 22 bp, Artificial Sequence
  Synthetic construct
agcgaccccgttagcgaagttg

SEQ ID NO: 9574 - DNA, 22 bp, Artificial Sequence
  Synthetic construct
gcgaccccgttagcgaagttgc

SEQ ID NO: 9575 - DNA, 22 bp, Artificial Sequence
  Synthetic construct
cgaccccgttagcgaagttgct

SEQ ID NO: 9576 - DNA, 22 bp, Artificial Sequence
  Synthetic construct
gaccccgttagcgaagttgctt

SEQ ID NO: 9577 - DNA, 22 bp, Artificial Sequence
  Synthetic construct
accccgttagcgaagttgcttg

SEQ ID NO: 9578 - DNA, 22 bp, Artificial Sequence
  Synthetic construct
ccccgttagcgaagttgcttgg

SEQ ID NO: 9579 - DNA, 22 bp, Artificial Sequence
  Synthetic construct
cccgttagcgaagttgcttggg

SEQ ID NO: 9580 - DNA, 22 bp, Artificial Sequence
  Synthetic construct
ccgttagcgaagttgcttgggg

SEQ ID NO: 9581 - DNA, 22 bp, Artificial Sequence
  Synthetic construct
cgttagcgaagttgcttggggc

SEQ ID NO: 9582 - DNA, 22 bp, Artificial Sequence
  Synthetic construct
gttagcgaagttgcttggggcg

SEQ ID NO: 9583 - DNA, 22 bp, Artificial Sequence
  Synthetic construct
ttagcgaagttgcttggggcga

SEQ ID NO: 9584 - DNA, 22 bp, Artificial Sequence
  Synthetic construct
tagcgaagttgcttggggcgac

SEQ ID NO: 9585 - DNA, 22 bp, Artificial Sequence
  Synthetic construct
agcgaagttgcttggggcgaca

SEQ ID NO: 9586 - DNA, 22 bp, Artificial Sequence
  Synthetic construct
gcgaagttgcttggggcgacag

SEQ ID NO: 9587 - DNA, 22 bp, Artificial Sequence
  Synthetic construct
cgaagttgcttggggcgacagt

SEQ ID NO: 9588 - DNA, 22 bp, Artificial Sequence
  Synthetic construct
gaagttgcttggggcgacagtc

SEQ ID NO: 9589 - DNA, 22 bp, Artificial Sequence
  Synthetic construct
aagttgcttggggcgacagtca

SEQ ID NO: 9590 - DNA, 22 bp, Artificial Sequence
  Synthetic construct
agttgcttggggcgacagtcac

SEQ ID NO: 9591 - DNA, 22 bp, Artificial Sequence
  Synthetic construct
gttgcttggggcgacagtcacg

SEQ ID NO: 9592 - DNA, 22 bp, Artificial Sequence
  Synthetic construct
ttgcttggggcgacagtcacgt

SEQ ID NO: 9593 - DNA, 22 bp, Artificial Sequence
  Synthetic construct
tgcttggggcgacagtcacgtc

SEQ ID NO: 9594 - DNA, 22 bp, Artificial Sequence
  Synthetic construct
gcttggggcgacagtcacgtcg

SEQ ID NO: 9595 - DNA, 22 bp, Artificial Sequence
  Synthetic construct
cttggggcgacagtcacgtcgc

SEQ ID NO: 9596 - DNA, 22 bp, Artificial Sequence
  Synthetic construct
ttggggcgacagtcacgtcgcc

SEQ ID NO: 9597 - DNA, 22 bp, Artificial Sequence
  Synthetic construct
tggggcgacagtcacgtcgcca

SEQ ID NO: 9598 - DNA, 22 bp, Artificial Sequence
  Synthetic construct
ggggcgacagtcacgtcgccag

SEQ ID NO: 9599 - DNA, 22 bp, Artificial Sequence
  Synthetic construct
gggcgacagtcacgtcgccagt

SEQ ID NO: 9600 - DNA, 22 bp, Artificial Sequence
  Synthetic construct
ggcgacagtcacgtcgccagtt

SEQ ID NO: 9601 - DNA, 22 bp, Artificial Sequence
  Synthetic construct
gcgacagtcacgtcgccagttc

SEQ ID NO: 9602 - DNA, 22 bp, Artificial Sequence
  Synthetic construct
cgacagtcacgtcgccagttcc

SEQ ID NO: 9603 - DNA, 22 bp, Artificial Sequence
  Synthetic construct
gacagtcacgtcgccagttccg

SEQ ID NO: 9604 - DNA, 22 bp, Artificial Sequence
  Synthetic construct
acagtcacgtcgccagttccgc

SEQ ID NO: 9605 - DNA, 22 bp, Artificial Sequence
  Synthetic construct
cagtcacgtcgccagttccgcc

SEQ ID NO: 9606 - DNA, 22 bp, Artificial Sequence
  Synthetic construct
agtcacgtcgccagttccgcca

SEQ ID NO: 9607 - DNA, 22 bp, Artificial Sequence
  Synthetic construct
gtcacgtcgccagttccgccat

SEQ ID NO: 9608 - DNA, 22 bp, Artificial Sequence
  Synthetic construct
tcacgtcgccagttccgccatt

SEQ ID NO: 9609 - DNA, 22 bp, Artificial Sequence
  Synthetic construct
cacgtcgccagttccgccattg

SEQ ID NO: 9610 - DNA, 22 bp, Artificial Sequence
  Synthetic construct
acgtcgccagttccgccattgt

SEQ ID NO: 9611 - DNA, 22 bp, Artificial Sequence
  Synthetic construct
cgtcgccagttccgccattgtc

SEQ ID NO: 9612 - DNA, 22 bp, Artificial Sequence
  Synthetic construct
gtcgccagttccgccattgtcg

SEQ ID NO: 9613 - DNA, 22 bp, Artificial Sequence
  Synthetic construct
tcgccagttccgccattgtcga

SEQ ID NO: 9614 - DNA, 22 bp, Artificial Sequence
  Synthetic construct
cgccagttccgccattgtcgac

SEQ ID NO: 9615 - DNA, 22 bp, Artificial Sequence
  Synthetic construct
gccagttccgccattgtcgacg

SEQ ID NO: 9616 - DNA, 22 bp, Artificial Sequence
  Synthetic construct
ccagttccgccattgtcgacga

SEQ ID NO: 9617 - DNA, 22 bp, Artificial Sequence
  Synthetic construct
cagttccgccattgtcgacgag

SEQ ID NO: 9618 - DNA, 22 bp, Artificial Sequence
  Synthetic construct
agttccgccattgtcgacgaga

SEQ ID NO: 9619 - DNA, 22 bp, Artificial Sequence
  Synthetic construct
gttccgccattgtcgacgagaa

SEQ ID NO: 9620 - DNA, 22 bp, Artificial Sequence
  Synthetic construct
ttccgccattgtcgacgagaac

SEQ ID NO: 9621 - DNA, 22 bp, Artificial Sequence
  Synthetic construct
tccgccattgtcgacgagaacg

SEQ ID NO: 9622 - DNA, 22 bp, Artificial Sequence
  Synthetic construct
ccgccattgtcgacgagaacga

SEQ ID NO: 9623 - DNA, 22 bp, Artificial Sequence
  Synthetic construct
cgccattgtcgacgagaacgaa

SEQ ID NO: 9624 - DNA, 22 bp, Artificial Sequence
  Synthetic construct
gccattgtcgacgagaacgaac

SEQ ID NO: 9625 - DNA, 22 bp, Artificial Sequence
  Synthetic construct
ccattgtcgacgagaacgaact

SEQ ID NO: 9626 - DNA, 22 bp, Artificial Sequence
  Synthetic construct
cattgtcgacgagaacgaactg

SEQ ID NO: 9627 - DNA, 22 bp, Artificial Sequence
  Synthetic construct
attgtcgacgagaacgaactga

SEQ ID NO: 9628 - DNA, 22 bp, Artificial Sequence
  Synthetic construct
ttgtcgacgagaacgaactgag

SEQ ID NO: 9629 - DNA, 22 bp, Artificial Sequence
  Synthetic construct
tgtcgacgagaacgaactgagt

SEQ ID NO: 9630 - DNA, 22 bp, Artificial Sequence
  Synthetic construct
gtcgacgagaacgaactgagta

SEQ ID NO: 9631 - DNA, 22 bp, Artificial Sequence
  Synthetic construct
tcgacgagaacgaactgagtaa

SEQ ID NO: 9632 - DNA, 22 bp, Artificial Sequence
  Synthetic construct
cgacgagaacgaactgagtaaa

SEQ ID NO: 9633 - DNA, 22 bp, Artificial Sequence
  Synthetic construct
gacgagaacgaactgagtaaag

SEQ ID NO: 9634 - DNA, 22 bp, Artificial Sequence
  Synthetic construct
acgagaacgaactgagtaaagt

SEQ ID NO: 9635 - DNA, 22 bp, Artificial Sequence
  Synthetic construct
cgagaacgaactgagtaaagtt

SEQ ID NO: 9636 - DNA, 22 bp, Artificial Sequence
  Synthetic construct
gagaacgaactgagtaaagtta

SEQ ID NO: 9637 - DNA, 22 bp, Artificial Sequence
  Synthetic construct
agaacgaactgagtaaagttag

SEQ ID NO: 9638 - DNA, 22 bp, Artificial Sequence
  Synthetic construct
gaacgaactgagtaaagttaga

SEQ ID NO: 9639 - DNA, 22 bp, Artificial Sequence
  Synthetic construct
aacgaactgagtaaagttagaa

SEQ ID NO: 9640 - DNA, 22 bp, Artificial Sequence
  Synthetic construct
acgaactgagtaaagttagaag

SEQ ID NO: 9641 - DNA, 22 bp, Artificial Sequence
  Synthetic construct
cgaactgagtaaagttagaagc

SEQ ID NO: 9642 - DNA, 22 bp, Artificial Sequence
  Synthetic construct
gaactgagtaaagttagaagcc

SEQ ID NO: 9643 - DNA, 22 bp, Artificial Sequence
  Synthetic construct
aactgagtaaagttagaagcca

SEQ ID NO: 9644 - DNA, 22 bp, Artificial Sequence
  Synthetic construct
actgagtaaagttagaagccat

SEQ ID NO: 9645 - DNA, 22 bp, Artificial Sequence
  Synthetic construct
ctgagtaaagttagaagccatg

SEQ ID NO: 9646 - DNA, 22 bp, Artificial Sequence
  Synthetic construct
tgagtaaagttagaagccatgc

SEQ ID NO: 9647 - DNA, 22 bp, Artificial Sequence
  Synthetic construct
gagtaaagttagaagccatgct

SEQ ID NO: 9648 - DNA, 22 bp, Artificial Sequence
  Synthetic construct
agtaaagttagaagccatgctt

SEQ ID NO: 9649 - DNA, 22 bp, Artificial Sequence
  Synthetic construct
gtaaagttagaagccatgcttc

SEQ ID NO: 9650 - DNA, 22 bp, Artificial Sequence
  Synthetic construct
taaagttagaagccatgcttca

SEQ ID NO: 9651 - DNA, 22 bp, Artificial Sequence
  Synthetic construct
aaagttagaagccatgcttcaa

SEQ ID NO: 9652 - DNA, 22 bp, Artificial Sequence
  Synthetic construct
aagttagaagccatgcttcaaa

SEQ ID NO: 9653 - DNA, 22 bp, Artificial Sequence
  Synthetic construct
agttagaagccatgcttcaaac

SEQ ID NO: 9654 - DNA, 22 bp, Artificial Sequence
  Synthetic construct
gttagaagccatgcttcaaact

SEQ ID NO: 9655 - DNA, 22 bp, Artificial Sequence
  Synthetic construct
ttagaagccatgcttcaaactc

SEQ ID NO: 9656 - DNA, 22 bp, Artificial Sequence
  Synthetic construct
tagaagccatgcttcaaactcc

SEQ ID NO: 9657 - DNA, 22 bp, Artificial Sequence
  Synthetic construct
agaagccatgcttcaaactccg

SEQ ID NO: 9658 - DNA, 22 bp, Artificial Sequence
  Synthetic construct
gaagccatgcttcaaactccgg

SEQ ID NO: 9659 - DNA, 22 bp, Artificial Sequence
  Synthetic construct
aagccatgcttcaaactccggt

SEQ ID NO: 9660 - DNA, 22 bp, Artificial Sequence
  Synthetic construct
agccatgcttcaaactccggtt

SEQ ID NO: 9661 - DNA, 22 bp, Artificial Sequence
  Synthetic construct
gccatgcttcaaactccggttg

SEQ ID NO: 9662 - DNA, 22 bp, Artificial Sequence
  Synthetic construct
ccatgcttcaaactccggttga

SEQ ID NO: 9663 - DNA, 22 bp, Artificial Sequence
  Synthetic construct
catgcttcaaactccggttgag

SEQ ID NO: 9664 - DNA, 22 bp, Artificial Sequence
  Synthetic construct
atgcttcaaactccggttgagg

SEQ ID NO: 9665 - DNA, 22 bp, Artificial Sequence
  Synthetic construct
tgcttcaaactccggttgaggg

SEQ ID NO: 9666 - DNA, 22 bp, Artificial Sequence
  Synthetic construct
gcttcaaactccggttgagggc

SEQ ID NO: 9667 - DNA, 22 bp, Artificial Sequence
  Synthetic construct
cttcaaactccggttgagggct

SEQ ID NO: 9668 - DNA, 22 bp, Artificial Sequence
  Synthetic construct
ttcaaactccggttgagggctc

SEQ ID NO: 9669 - DNA, 22 bp, Artificial Sequence
  Synthetic construct
tcaaactccggttgagggctct

SEQ ID NO: 9670 - DNA, 22 bp, Artificial Sequence
  Synthetic construct
caaactccggttgagggctcta

SEQ ID NO: 9671 - DNA, 22 bp, Artificial Sequence
  Synthetic construct
aaactccggttgagggctctat

SEQ ID NO: 9672 - DNA, 22 bp, Artificial Sequence
  Synthetic construct
aactccggttgagggctctatc

SEQ ID NO: 9673 - DNA, 22 bp, Artificial Sequence
  Synthetic construct
actccggttgagggctctatct

SEQ ID NO: 9674 - DNA, 22 bp, Artificial Sequence
  Synthetic construct
ctccggttgagggctctatcta

SEQ ID NO: 9675 - DNA, 22 bp, Artificial Sequence
  Synthetic construct
tccggttgagggctctatctag

SEQ ID NO: 9676 - DNA, 22 bp, Artificial Sequence
  Synthetic construct
ccggttgagggctctatctaga

SEQ ID NO: 9677 - DNA, 22 bp, Artificial Sequence
  Synthetic construct
cggttgagggctctatctagag

SEQ ID NO: 9678 - DNA, 22 bp, Artificial Sequence
  Synthetic construct
ggttgagggctctatctagaga

SEQ ID NO: 9679 - DNA, 22 bp, Artificial Sequence
  Synthetic construct
gttgagggctctatctagagag

SEQ ID NO: 9680 - DNA, 22 bp, Artificial Sequence
  Synthetic construct
ttgagggctctatctagagagc

SEQ ID NO: 9681 - DNA, 22 bp, Artificial Sequence
  Synthetic construct
tgagggctctatctagagagcc

SEQ ID NO: 9682 - DNA, 22 bp, Artificial Sequence
  Synthetic construct
gagggctctatctagagagccg

SEQ ID NO: 9683 - DNA, 22 bp, Artificial Sequence
  Synthetic construct
agggctctatctagagagccgt

SEQ ID NO: 9684 - DNA, 22 bp, Artificial Sequence
  Synthetic construct
gggctctatctagagagccgtt

SEQ ID NO: 9685 - DNA, 22 bp, Artificial Sequence
  Synthetic construct
ggctctatctagagagccgttg

SEQ ID NO: 9686 - DNA, 22 bp, Artificial Sequence
  Synthetic construct
gctctatctagagagccgttgc

SEQ ID NO: 9687 - DNA, 22 bp, Artificial Sequence
  Synthetic construct
ctctatctagagagccgttgcc

SEQ ID NO: 9688 - DNA, 22 bp, Artificial Sequence
  Synthetic construct
tctatctagagagccgttgcct

SEQ ID NO: 9689 - DNA, 22 bp, Artificial Sequence
  Synthetic construct
ctatctagagagccgttgcctg

SEQ ID NO: 9690 - DNA, 22 bp, Artificial Sequence
  Synthetic construct
tatctagagagccgttgcctga

SEQ ID NO: 9691 - DNA, 22 bp, Artificial Sequence
  Synthetic construct
atctagagagccgttgcctgat

SEQ ID NO: 9692 - DNA, 22 bp, Artificial Sequence
  Synthetic construct
tctagagagccgttgcctgatt

SEQ ID NO: 9693 - DNA, 22 bp, Artificial Sequence
  Synthetic construct
ctagagagccgttgcctgatta

SEQ ID NO: 9694 - DNA, 22 bp, Artificial Sequence
  Synthetic construct
tagagagccgttgcctgattaa

SEQ ID NO: 9695 - DNA, 22 bp, Artificial Sequence
  Synthetic construct
agagagccgttgcctgattaat

SEQ ID NO: 9696 - DNA, 22 bp, Artificial Sequence
  Synthetic construct
gagagccgttgcctgattaatg

SEQ ID NO: 9697 - DNA, 22 bp, Artificial Sequence
  Synthetic construct
agagccgttgcctgattaatgc

SEQ ID NO: 9698 - DNA, 22 bp, Artificial Sequence
  Synthetic construct
gagccgttgcctgattaatgct

SEQ ID NO: 9699 - DNA, 22 bp, Artificial Sequence
  Synthetic construct
agccgttgcctgattaatgcta

SEQ ID NO: 9700 - DNA, 22 bp, Artificial Sequence
  Synthetic construct
gccgttgcctgattaatgctaa

SEQ ID NO: 9701 - DNA, 22 bp, Artificial Sequence
  Synthetic construct
ccgttgcctgattaatgctaac

SEQ ID NO: 9702 - DNA, 22 bp, Artificial Sequence
  Synthetic construct
cgttgcctgattaatgctaacg

SEQ ID NO: 9703 - DNA, 22 bp, Artificial Sequence
  Synthetic construct
gttgcctgattaatgctaacgc

SEQ ID NO: 9704 - DNA, 22 bp, Artificial Sequence
  Synthetic construct
ttgcctgattaatgctaacgca

SEQ ID NO: 9705 - DNA, 22 bp, Artificial Sequence
  Synthetic construct
tgcctgattaatgctaacgcat

SEQ ID NO: 9706 - DNA, 22 bp, Artificial Sequence
  Synthetic construct
gcctgattaatgctaacgcatc

SEQ ID NO: 9707 - DNA, 22 bp, Artificial Sequence
  Synthetic construct
cctgattaatgctaacgcatct

SEQ ID NO: 9708 - DNA, 22 bp, Artificial Sequence
  Synthetic construct
ctgattaatgctaacgcatcta

SEQ ID NO: 9709 - DNA, 22 bp, Artificial Sequence
  Synthetic construct
tgattaatgctaacgcatctaa

SEQ ID NO: 9710 - DNA, 22 bp, Artificial Sequence
  Synthetic construct
gattaatgctaacgcatctaag

SEQ ID NO: 9711 - DNA, 22 bp, Artificial Sequence
  Synthetic construct
attaatgctaacgcatctaagg

SEQ ID NO: 9712 - DNA, 22 bp, Artificial Sequence
  Synthetic construct
ttaatgctaacgcatctaaggt

SEQ ID NO: 9713 - DNA, 22 bp, Artificial Sequence
  Synthetic construct
taatgctaacgcatctaaggta

SEQ ID NO: 9714 - DNA, 22 bp, Artificial Sequence
  Synthetic construct
aatgctaacgcatctaaggtat

SEQ ID NO: 9715 - DNA, 22 bp, Artificial Sequence
  Synthetic construct
atgctaacgcatctaaggtatg

SEQ ID NO: 9716 - DNA, 22 bp, Artificial Sequence
  Synthetic construct
tgctaacgcatctaaggtatgg

SEQ ID NO: 9717 - DNA, 22 bp, Artificial Sequence
  Synthetic construct
gctaacgcatctaaggtatgga

SEQ ID NO: 9718 - DNA, 22 bp, Artificial Sequence
  Synthetic construct
ctaacgcatctaaggtatggac

SEQ ID NO: 9719 - DNA, 22 bp, Artificial Sequence
  Synthetic construct
taacgcatctaaggtatggacc

SEQ ID NO: 9720 - DNA, 22 bp, Artificial Sequence
  Synthetic construct
aacgcatctaaggtatggacca

SEQ ID NO: 9721 - DNA, 22 bp, Artificial Sequence
  Synthetic construct
acgcatctaaggtatggaccat

SEQ ID NO: 9722 - DNA, 22 bp, Artificial Sequence
  Synthetic construct
cgcatctaaggtatggaccatc

SEQ ID NO: 9723 - DNA, 22 bp, Artificial Sequence
  Synthetic construct
gcatctaaggtatggaccatcg

SEQ ID NO: 9724 - DNA, 22 bp, Artificial Sequence
  Synthetic construct
catctaaggtatggaccatcga

SEQ ID NO: 9725 - DNA, 22 bp, Artificial Sequence
  Synthetic construct
atctaaggtatggaccatcgag

SEQ ID NO: 9726 - DNA, 22 bp, Artificial Sequence
  Synthetic construct
tctaaggtatggaccatcgaga

SEQ ID NO: 9727 - DNA, 22 bp, Artificial Sequence
  Synthetic construct
ctaaggtatggaccatcgagaa

SEQ ID NO: 9728 - DNA, 22 bp, Artificial Sequence
  Synthetic construct
taaggtatggaccatcgagaaa

SEQ ID NO: 9729 - DNA, 22 bp, Artificial Sequence
  Synthetic construct
aaggtatggaccatcgagaaag

SEQ ID NO: 9730 - DNA, 22 bp, Artificial Sequence
  Synthetic construct
aggtatggaccatcgagaaagg

SEQ ID NO: 9731 - DNA, 22 bp, Artificial Sequence
  Synthetic construct
ggtatggaccatcgagaaagga

SEQ ID NO: 9732 - DNA, 22 bp, Artificial Sequence
  Synthetic construct
gtatggaccatcgagaaaggag

SEQ ID NO: 9733 - DNA, 22 bp, Artificial Sequence
  Synthetic construct
tatggaccatcgagaaaggaga

SEQ ID NO: 9734 - DNA, 22 bp, Artificial Sequence
  Synthetic construct
atggaccatcgagaaaggagac

SEQ ID NO: 9735 - DNA, 22 bp, Artificial Sequence
  Synthetic construct
tggaccatcgagaaaggagact

SEQ ID NO: 9736 - DNA, 22 bp, Artificial Sequence
  Synthetic construct
ggaccatcgagaaaggagactt

SEQ ID NO: 9737 - DNA, 22 bp, Artificial Sequence
  Synthetic construct
gaccatcgagaaaggagacttt

SEQ ID NO: 9738 - DNA, 22 bp, Artificial Sequence
  Synthetic construct
accatcgagaaaggagacttta

SEQ ID NO: 9739 - DNA, 22 bp, Artificial Sequence
  Synthetic construct
ccatcgagaaaggagactttac

SEQ ID NO: 9740 - DNA, 22 bp, Artificial Sequence
  Synthetic construct
catcgagaaaggagactttacg

SEQ ID NO: 9741 - DNA, 22 bp, Artificial Sequence
  Synthetic construct
atcgagaaaggagactttacgt

SEQ ID NO: 9742 - DNA, 22 bp, Artificial Sequence
  Synthetic construct
tcgagaaaggagactttacgta

SEQ ID NO: 9743 - DNA, 22 bp, Artificial Sequence
  Synthetic construct
cgagaaaggagactttacgtac

SEQ ID NO: 9744 - DNA, 22 bp, Artificial Sequence
  Synthetic construct
gagaaaggagactttacgtacg

SEQ ID NO: 9745 - DNA, 22 bp, Artificial Sequence
  Synthetic construct
agaaaggagactttacgtacgc

SEQ ID NO: 9746 - DNA, 22 bp, Artificial Sequence
  Synthetic construct
gaaaggagactttacgtacgcg

SEQ ID NO: 9747 - DNA, 22 bp, Artificial Sequence
  Synthetic construct
aaaggagactttacgtacgcgc

SEQ ID NO: 9748 - DNA, 22 bp, Artificial Sequence
  Synthetic construct
aaggagactttacgtacgcgcc

SEQ ID NO: 9749 - DNA, 22 bp, Artificial Sequence
  Synthetic construct
aggagactttacgtacgcgcca

SEQ ID NO: 9750 - DNA, 22 bp, Artificial Sequence
  Synthetic construct
ggagactttacgtacgcgccag

SEQ ID NO: 9751 - DNA, 22 bp, Artificial Sequence
  Synthetic construct
gagactttacgtacgcgccagt

SEQ ID NO: 9752 - DNA, 22 bp, Artificial Sequence
  Synthetic construct
agactttacgtacgcgccagtt

SEQ ID NO: 9753 - DNA, 22 bp, Artificial Sequence
  Synthetic construct
gactttacgtacgcgccagttg

SEQ ID NO: 9754 - DNA, 22 bp, Artificial Sequence
  Synthetic construct
actttacgtacgcgccagttgt

SEQ ID NO: 9755 - DNA, 22 bp, Artificial Sequence
  Synthetic construct
ctttacgtacgcgccagttgtt

SEQ ID NO: 9756 - DNA, 22 bp, Artificial Sequence
  Synthetic construct
tttacgtacgcgccagttgttg

SEQ ID NO: 9757 - DNA, 22 bp, Artificial Sequence
  Synthetic construct
ttacgtacgcgccagttgttgg

SEQ ID NO: 9758 - DNA, 22 bp, Artificial Sequence
  Synthetic construct
tacgtacgcgccagttgttggc

SEQ ID NO: 9759 - DNA, 22 bp, Artificial Sequence
  Synthetic construct
acgtacgcgccagttgttggcc

SEQ ID NO: 9760 - DNA, 22 bp, Artificial Sequence
  Synthetic construct
cgtacgcgccagttgttggcca

SEQ ID NO: 9761 - DNA, 22 bp, Artificial Sequence
  Synthetic construct
gtacgcgccagttgttggccat

SEQ ID NO: 9762 - DNA, 22 bp, Artificial Sequence
  Synthetic construct
tacgcgccagttgttggccata

SEQ ID NO: 9763 - DNA, 22 bp, Artificial Sequence
  Synthetic construct
acgcgccagttgttggccatac

SEQ ID NO: 9764 - DNA, 22 bp, Artificial Sequence
  Synthetic construct
cgcgccagttgttggccatacg

SEQ ID NO: 9765 - DNA, 22 bp, Artificial Sequence
  Synthetic construct
gcgccagttgttggccatacgg

SEQ ID NO: 9766 - DNA, 22 bp, Artificial Sequence
  Synthetic construct
cgccagttgttggccatacgga

SEQ ID NO: 9767 - DNA, 22 bp, Artificial Sequence
  Synthetic construct
gccagttgttggccatacggat

SEQ ID NO: 9768 - DNA, 22 bp, Artificial Sequence
  Synthetic construct
ccagttgttggccatacggatt

SEQ ID NO: 9769 - DNA, 22 bp, Artificial Sequence
  Synthetic construct
cagttgttggccatacggattg

SEQ ID NO: 9770 - DNA, 22 bp, Artificial Sequence
  Synthetic construct
agttgttggccatacggattgt

SEQ ID NO: 9771 - DNA, 22 bp, Artificial Sequence
  Synthetic construct
gttgttggccatacggattgta

SEQ ID NO: 9772 - DNA, 22 bp, Artificial Sequence
  Synthetic construct
ttgttggccatacggattgtac

SEQ ID NO: 9773 - DNA, 22 bp, Artificial Sequence
  Synthetic construct
tgttggccatacggattgtacc

SEQ ID NO: 9774 - DNA, 22 bp, Artificial Sequence
  Synthetic construct
gttggccatacggattgtaccc

SEQ ID NO: 9775 - DNA, 22 bp, Artificial Sequence
  Synthetic construct
ttggccatacggattgtacccc

SEQ ID NO: 9776 - DNA, 22 bp, Artificial Sequence
  Synthetic construct
tggccatacggattgtacccct

SEQ ID NO: 9777 - DNA, 22 bp, Artificial Sequence
  Synthetic construct
ggccatacggattgtacccctc

SEQ ID NO: 9778 - DNA, 22 bp, Artificial Sequence
  Synthetic construct
gccatacggattgtacccctcg

SEQ ID NO: 9779 - DNA, 22 bp, Artificial Sequence
  Synthetic construct
ccatacggattgtacccctcga

SEQ ID NO: 9780 - DNA, 22 bp, Artificial Sequence
  Synthetic construct
catacggattgtacccctcgat

SEQ ID NO: 9781 - DNA, 22 bp, Artificial Sequence
  Synthetic construct
atacggattgtacccctcgatg

SEQ ID NO: 9782 - DNA, 22 bp, Artificial Sequence
  Synthetic construct
tacggattgtacccctcgatgc

SEQ ID NO: 9783 - DNA, 22 bp, Artificial Sequence
  Synthetic construct
acggattgtacccctcgatgca

SEQ ID NO: 9784 - DNA, 22 bp, Artificial Sequence
  Synthetic construct
cggattgtacccctcgatgcat

SEQ ID NO: 9785 - DNA, 22 bp, Artificial Sequence
  Synthetic construct
ggattgtacccctcgatgcatg

SEQ ID NO: 9786 - DNA, 22 bp, Artificial Sequence
  Synthetic construct
gattgtacccctcgatgcatgg

SEQ ID NO: 9787 - DNA, 22 bp, Artificial Sequence
  Synthetic construct
attgtacccctcgatgcatggc

SEQ ID NO: 9788 - DNA, 22 bp, Artificial Sequence
  Synthetic construct
ttgtacccctcgatgcatggct

SEQ ID NO: 9789 - DNA, 22 bp, Artificial Sequence
  Synthetic construct
tgtacccctcgatgcatggctg

SEQ ID NO: 9790 - DNA, 22 bp, Artificial Sequence
  Synthetic construct
gtacccctcgatgcatggctga

SEQ ID NO: 9791 - DNA, 22 bp, Artificial Sequence
  Synthetic construct
tacccctcgatgcatggctgag

SEQ ID NO: 9792 - DNA, 22 bp, Artificial Sequence
  Synthetic construct
acccctcgatgcatggctgaga

SEQ ID NO: 9793 - DNA, 22 bp, Artificial Sequence
  Synthetic construct
cccctcgatgcatggctgagat

SEQ ID NO: 9794 - DNA, 22 bp, Artificial Sequence
  Synthetic construct
ccctcgatgcatggctgagatt

SEQ ID NO: 9795 - DNA, 22 bp, Artificial Sequence
  Synthetic construct
cctcgatgcatggctgagattt

SEQ ID NO: 9796 - DNA, 22 bp, Artificial Sequence
  Synthetic construct
ctcgatgcatggctgagatttg

SEQ ID NO: 9797 - DNA, 22 bp, Artificial Sequence
  Synthetic construct
tcgatgcatggctgagatttgg

SEQ ID NO: 9798 - DNA, 22 bp, Artificial Sequence
  Synthetic construct
cgatgcatggctgagatttggg

SEQ ID NO: 9799 - DNA, 22 bp, Artificial Sequence
  Synthetic construct
gatgcatggctgagatttgggc

SEQ ID NO: 9800 - DNA, 22 bp, Artificial Sequence
  Synthetic construct
atgcatggctgagatttgggcc

SEQ ID NO: 9801 - DNA, 22 bp, Artificial Sequence
  Synthetic construct
tgcatggctgagatttgggcct

SEQ ID NO: 9802 - DNA, 22 bp, Artificial Sequence
  Synthetic construct
gcatggctgagatttgggcctt

SEQ ID NO: 9803 - DNA, 22 bp, Artificial Sequence
  Synthetic construct
catggctgagatttgggcctta

SEQ ID NO: 9804 - DNA, 22 bp, Artificial Sequence
  Synthetic construct
atggctgagatttgggccttag

SEQ ID NO: 9805 - DNA, 22 bp, Artificial Sequence
  Synthetic construct
tggctgagatttgggccttagc

SEQ ID NO: 9806 - DNA, 22 bp, Artificial Sequence
  Synthetic construct
ggctgagatttgggccttagca

SEQ ID NO: 9807 - DNA, 22 bp, Artificial Sequence
  Synthetic construct
gctgagatttgggccttagcag

SEQ ID NO: 9808 - DNA, 22 bp, Artificial Sequence
  Synthetic construct
ctgagatttgggccttagcagt

SEQ ID NO: 9809 - DNA, 22 bp, Artificial Sequence
  Synthetic construct
tgagatttgggccttagcagtg

SEQ ID NO: 9810 - DNA, 22 bp, Artificial Sequence
  Synthetic construct
gagatttgggccttagcagtgc

SEQ ID NO: 9811 - DNA, 22 bp, Artificial Sequence
  Synthetic construct
agatttgggccttagcagtgcc

SEQ ID NO: 9812 - DNA, 22 bp, Artificial Sequence
  Synthetic construct
gatttgggccttagcagtgccc

SEQ ID NO: 9813 - DNA, 22 bp, Artificial Sequence
  Synthetic construct
atttgggccttagcagtgccct

SEQ ID NO: 9814 - DNA, 22 bp, Artificial Sequence
  Synthetic construct
tttgggccttagcagtgccctg

SEQ ID NO: 9815 - DNA, 22 bp, Artificial Sequence
  Synthetic construct
ttgggccttagcagtgccctgt

SEQ ID NO: 9816 - DNA, 22 bp, Artificial Sequence
  Synthetic construct
tgggccttagcagtgccctgtc

SEQ ID NO: 9817 - DNA, 22 bp, Artificial Sequence
  Synthetic construct
gggccttagcagtgccctgtct

SEQ ID NO: 9818 - DNA, 22 bp, Artificial Sequence
  Synthetic construct
ggccttagcagtgccctgtctc

SEQ ID NO: 9819 - DNA, 22 bp, Artificial Sequence
  Synthetic construct
gccttagcagtgccctgtctct

SEQ ID NO: 9820 - DNA, 22 bp, Artificial Sequence
  Synthetic construct
ccttagcagtgccctgtctctc

SEQ ID NO: 9821 - DNA, 22 bp, Artificial Sequence
  Synthetic construct
cttagcagtgccctgtctctcc

SEQ ID NO: 9822 - DNA, 22 bp, Artificial Sequence
  Synthetic construct
ttagcagtgccctgtctctcca

SEQ ID NO: 9823 - DNA, 22 bp, Artificial Sequence
  Synthetic construct
tagcagtgccctgtctctccac

SEQ ID NO: 9824 - DNA, 22 bp, Artificial Sequence
  Synthetic construct
agcagtgccctgtctctccaca

SEQ ID NO: 9825 - DNA, 22 bp, Artificial Sequence
  Synthetic construct
gcagtgccctgtctctccacag

SEQ ID NO: 9826 - DNA, 22 bp, Artificial Sequence
  Synthetic construct
cagtgccctgtctctccacagt

SEQ ID NO: 9827 - DNA, 22 bp, Artificial Sequence
  Synthetic construct
agtgccctgtctctccacagtc

SEQ ID NO: 9828 - DNA, 22 bp, Artificial Sequence
  Synthetic construct
gtgccctgtctctccacagtcc

SEQ ID NO: 9829 - DNA, 22 bp, Artificial Sequence
  Synthetic construct
tgccctgtctctccacagtcca

SEQ ID NO: 9830 - DNA, 22 bp, Artificial Sequence
  Synthetic construct
gccctgtctctccacagtccac

SEQ ID NO: 9831 - DNA, 22 bp, Artificial Sequence
  Synthetic construct
ccctgtctctccacagtccacc

SEQ ID NO: 9832 - DNA, 22 bp, Artificial Sequence
  Synthetic construct
cctgtctctccacagtccaccc

SEQ ID NO: 9833 - DNA, 22 bp, Artificial Sequence
  Synthetic construct
ctgtctctccacagtccacccg

SEQ ID NO: 9834 - DNA, 22 bp, Artificial Sequence
  Synthetic construct
tgtctctccacagtccacccgt

SEQ ID NO: 9835 - DNA, 22 bp, Artificial Sequence
  Synthetic construct
gtctctccacagtccacccgta

SEQ ID NO: 9836 - DNA, 22 bp, Artificial Sequence
  Synthetic construct
tctctccacagtccacccgtag

SEQ ID NO: 9837 - DNA, 22 bp, Artificial Sequence
  Synthetic construct
ctctccacagtccacccgtagg

SEQ ID NO: 9838 - DNA, 22 bp, Artificial Sequence
  Synthetic construct
tctccacagtccacccgtaggg

SEQ ID NO: 9839 - DNA, 22 bp, Artificial Sequence
  Synthetic construct
ctccacagtccacccgtaggga

SEQ ID NO: 9840 - DNA, 22 bp, Artificial Sequence
  Synthetic construct
tccacagtccacccgtagggag

SEQ ID NO: 9841 - DNA, 22 bp, Artificial Sequence
  Synthetic construct
ccacagtccacccgtagggagc

SEQ ID NO: 9842 - DNA, 22 bp, Artificial Sequence
  Synthetic construct
cacagtccacccgtagggagcg

SEQ ID NO: 9843 - DNA, 22 bp, Artificial Sequence
  Synthetic construct
acagtccacccgtagggagcgt

SEQ ID NO: 9844 - DNA, 22 bp, Artificial Sequence
  Synthetic construct
cagtccacccgtagggagcgtc

SEQ ID NO: 9845 - DNA, 22 bp, Artificial Sequence
  Synthetic construct
agtccacccgtagggagcgtca

SEQ ID NO: 9846 - DNA, 22 bp, Artificial Sequence
  Synthetic construct
gtccacccgtagggagcgtcaa

SEQ ID NO: 9847 - DNA, 22 bp, Artificial Sequence
  Synthetic construct
tccacccgtagggagcgtcaac

SEQ ID NO: 9848 - DNA, 22 bp, Artificial Sequence
  Synthetic construct
ccacccgtagggagcgtcaacg

SEQ ID NO: 9849 - DNA, 22 bp, Artificial Sequence
  Synthetic construct
cacccgtagggagcgtcaacgc

SEQ ID NO: 9850 - DNA, 22 bp, Artificial Sequence
  Synthetic construct
acccgtagggagcgtcaacgct

SEQ ID NO: 9851 - DNA, 22 bp, Artificial Sequence
  Synthetic construct
cccgtagggagcgtcaacgctt

SEQ ID NO: 9852 - DNA, 22 bp, Artificial Sequence
  Synthetic construct
ccgtagggagcgtcaacgctta

SEQ ID NO: 9853 - DNA, 22 bp, Artificial Sequence
  Synthetic construct
cgtagggagcgtcaacgcttat

SEQ ID NO: 9854 - DNA, 22 bp, Artificial Sequence
  Synthetic construct
gtagggagcgtcaacgcttatg

SEQ ID NO: 9855 - DNA, 22 bp, Artificial Sequence
  Synthetic construct
tagggagcgtcaacgcttatga

SEQ ID NO: 9856 - DNA, 22 bp, Artificial Sequence
  Synthetic construct
agggagcgtcaacgcttatgat

SEQ ID NO: 9857 - DNA, 22 bp, Artificial Sequence
  Synthetic construct
gggagcgtcaacgcttatgatg

SEQ ID NO: 9858 - DNA, 22 bp, Artificial Sequence
  Synthetic construct
ggagcgtcaacgcttatgatgg

SEQ ID NO: 9859 - DNA, 22 bp, Artificial Sequence
  Synthetic construct
gagcgtcaacgcttatgatgga

SEQ ID NO: 9860 - DNA, 22 bp, Artificial Sequence
  Synthetic construct
agcgtcaacgcttatgatggac

SEQ ID NO: 9861 - DNA, 22 bp, Artificial Sequence
  Synthetic construct
gcgtcaacgcttatgatggact

SEQ ID NO: 9862 - DNA, 22 bp, Artificial Sequence
  Synthetic construct
cgtcaacgcttatgatggactc

SEQ ID NO: 9863 - DNA, 22 bp, Artificial Sequence
  Synthetic construct
gtcaacgcttatgatggactca

SEQ ID NO: 9864 - DNA, 22 bp, Artificial Sequence
  Synthetic construct
tcaacgcttatgatggactcac

SEQ ID NO: 9865 - DNA, 22 bp, Artificial Sequence
  Synthetic construct
caacgcttatgatggactcacc

SEQ ID NO: 9866 - DNA, 22 bp, Artificial Sequence
  Synthetic construct
aacgcttatgatggactcaccc

SEQ ID NO: 9867 - DNA, 22 bp, Artificial Sequence
  Synthetic construct
acgcttatgatggactcacccg

SEQ ID NO: 9868 - DNA, 22 bp, Artificial Sequence
  Synthetic construct
cgcttatgatggactcacccgt

SEQ ID NO: 9869 - DNA, 22 bp, Artificial Sequence
  Synthetic construct
gcttatgatggactcacccgtt

SEQ ID NO: 9870 - DNA, 22 bp, Artificial Sequence
  Synthetic construct
cttatgatggactcacccgtta

SEQ ID NO: 9871 - DNA, 22 bp, Artificial Sequence
  Synthetic construct
ttatgatggactcacccgttat

SEQ ID NO: 9872 - DNA, 22 bp, Artificial Sequence
  Synthetic construct
tatgatggactcacccgttatt

SEQ ID NO: 9873 - DNA, 22 bp, Artificial Sequence
  Synthetic construct
atgatggactcacccgttatta

SEQ ID NO: 9874 - DNA, 22 bp, Artificial Sequence
  Synthetic construct
tgatggactcacccgttattac

SEQ ID NO: 9875 - DNA, 22 bp, Artificial Sequence
  Synthetic construct
gatggactcacccgttattacg

SEQ ID NO: 9876 - DNA, 22 bp, Artificial Sequence
  Synthetic construct
atggactcacccgttattacgt

SEQ ID NO: 9877 - DNA, 22 bp, Artificial Sequence
  Synthetic construct
tggactcacccgttattacgtc

SEQ ID NO: 9878 - DNA, 22 bp, Artificial Sequence
  Synthetic construct
ggactcacccgttattacgtca

SEQ ID NO: 9879 - DNA, 22 bp, Artificial Sequence
  Synthetic construct
gactcacccgttattacgtcag

SEQ ID NO: 9880 - DNA, 22 bp, Artificial Sequence
  Synthetic construct
actcacccgttattacgtcagt

SEQ ID NO: 9881 - DNA, 22 bp, Artificial Sequence
  Synthetic construct
ctcacccgttattacgtcagta

SEQ ID NO: 9882 - DNA, 22 bp, Artificial Sequence
  Synthetic construct
tcacccgttattacgtcagtaa

SEQ ID NO: 9883 - DNA, 22 bp, Artificial Sequence
  Synthetic construct
cacccgttattacgtcagtaac

SEQ ID NO: 9884 - DNA, 22 bp, Artificial Sequence
  Synthetic construct
acccgttattacgtcagtaact

SEQ ID NO: 9885 - DNA, 22 bp, Artificial Sequence
  Synthetic construct
cccgttattacgtcagtaactg

SEQ ID NO: 9886 - DNA, 22 bp, Artificial Sequence
  Synthetic construct
ccgttattacgtcagtaactgt

SEQ ID NO: 9887 - DNA, 22 bp, Artificial Sequence
  Synthetic construct
cgttattacgtcagtaactgtt

SEQ ID NO: 9888 - DNA, 22 bp, Artificial Sequence
  Synthetic construct
gttattacgtcagtaactgttc

SEQ ID NO: 9889 - DNA, 22 bp, Artificial Sequence
  Synthetic construct
ttattacgtcagtaactgttcc

SEQ ID NO: 9890 - DNA, 22 bp, Artificial Sequence
  Synthetic construct
tattacgtcagtaactgttcct

SEQ ID NO: 9891 - DNA, 22 bp, Artificial Sequence
  Synthetic construct
attacgtcagtaactgttcctg

SEQ ID NO: 9892 - DNA, 22 bp, Artificial Sequence
  Synthetic construct
ttacgtcagtaactgttcctga

SEQ ID NO: 9893 - DNA, 22 bp, Artificial Sequence
  Synthetic construct
tacgtcagtaactgttcctgac

SEQ ID NO: 9894 - DNA, 22 bp, Artificial Sequence
  Synthetic construct
acgtcagtaactgttcctgaca

SEQ ID NO: 9895 - DNA, 22 bp, Artificial Sequence
  Synthetic construct
cgtcagtaactgttcctgacat

SEQ ID NO: 9896 - DNA, 22 bp, Artificial Sequence
  Synthetic construct
gtcagtaactgttcctgacatg

SEQ ID NO: 9897 - DNA, 22 bp, Artificial Sequence
  Synthetic construct
tcagtaactgttcctgacatgt

SEQ ID NO: 9898 - DNA, 22 bp, Artificial Sequence
  Synthetic construct
cagtaactgttcctgacatgta

SEQ ID NO: 9899 - DNA, 22 bp, Artificial Sequence
  Synthetic construct
agtaactgttcctgacatgtag

SEQ ID NO: 9900 - DNA, 22 bp, Artificial Sequence
  Synthetic construct
gtaactgttcctgacatgtagg

SEQ ID NO: 9901 - DNA, 22 bp, Artificial Sequence
  Synthetic construct
taactgttcctgacatgtagga

SEQ ID NO: 9902 - DNA, 22 bp, Artificial Sequence
  Synthetic construct
aactgttcctgacatgtaggag

SEQ ID NO: 9903 - DNA, 22 bp, Artificial Sequence
  Synthetic construct
actgttcctgacatgtaggagc

SEQ ID NO: 9904 - DNA, 22 bp, Artificial Sequence
  Synthetic construct
ctgttcctgacatgtaggagca

SEQ ID NO: 9905 - DNA, 22 bp, Artificial Sequence
  Synthetic construct
tgttcctgacatgtaggagcat

SEQ ID NO: 9906 - DNA, 22 bp, Artificial Sequence
  Synthetic construct
gttcctgacatgtaggagcatc

SEQ ID NO: 9907 - DNA, 22 bp, Artificial Sequence
  Synthetic construct
ttcctgacatgtaggagcatcc

SEQ ID NO: 9908 - DNA, 22 bp, Artificial Sequence
  Synthetic construct
tcctgacatgtaggagcatccc

SEQ ID NO: 9909 - DNA, 22 bp, Artificial Sequence
  Synthetic construct
cctgacatgtaggagcatccca

SEQ ID NO: 9910 - DNA, 22 bp, Artificial Sequence
  Synthetic construct
ctgacatgtaggagcatcccac

SEQ ID NO: 9911 - DNA, 22 bp, Artificial Sequence
  Synthetic construct
tgacatgtaggagcatcccacg

SEQ ID NO: 9912 - DNA, 22 bp, Artificial Sequence
  Synthetic construct
gacatgtaggagcatcccacgg

SEQ ID NO: 9913 - DNA, 22 bp, Artificial Sequence
  Synthetic construct
acatgtaggagcatcccacggg

SEQ ID NO: 9914 - DNA, 22 bp, Artificial Sequence
  Synthetic construct
catgtaggagcatcccacgggg

SEQ ID NO: 9915 - DNA, 22 bp, Artificial Sequence
  Synthetic construct
atgtaggagcatcccacggggg

SEQ ID NO: 9916 - DNA, 22 bp, Artificial Sequence
  Synthetic construct
tgtaggagcatcccacgggggc

SEQ ID NO: 9917 - DNA, 22 bp, Artificial Sequence
  Synthetic construct
gtaggagcatcccacgggggcc

SEQ ID NO: 9918 - DNA, 22 bp, Artificial Sequence
  Synthetic construct
taggagcatcccacgggggccg

SEQ ID NO: 9919 - DNA, 22 bp, Artificial Sequence
  Synthetic construct
aggagcatcccacgggggccgt

SEQ ID NO: 9920 - DNA, 22 bp, Artificial Sequence
  Synthetic construct
ggagcatcccacgggggccgta

SEQ ID NO: 9921 - DNA, 22 bp, Artificial Sequence
  Synthetic construct
gagcatcccacgggggccgtaa

SEQ ID NO: 9922 - DNA, 22 bp, Artificial Sequence
  Synthetic construct
agcatcccacgggggccgtaag

SEQ ID NO: 9923 - DNA, 22 bp, Artificial Sequence
  Synthetic construct
gcatcccacgggggccgtaagg

SEQ ID NO: 9924 - DNA, 22 bp, Artificial Sequence
  Synthetic construct
catcccacgggggccgtaaggc

SEQ ID NO: 9925 - DNA, 22 bp, Artificial Sequence
  Synthetic construct
atcccacgggggccgtaaggcc

SEQ ID NO: 9926 - DNA, 22 bp, Artificial Sequence
  Synthetic construct
tcccacgggggccgtaaggccc

SEQ ID NO: 9927 - DNA, 22 bp, Artificial Sequence
  Synthetic construct
cccacgggggccgtaaggccct

SEQ ID NO: 9928 - DNA, 22 bp, Artificial Sequence
  Synthetic construct
ccacgggggccgtaaggccctc

SEQ ID NO: 9929 - DNA, 22 bp, Artificial Sequence
  Synthetic construct
cacgggggccgtaaggccctcg

SEQ ID NO: 9930 - DNA, 22 bp, Artificial Sequence
  Synthetic construct
acgggggccgtaaggccctcga

SEQ ID NO: 9931 - DNA, 22 bp, Artificial Sequence
  Synthetic construct
cgggggccgtaaggccctcgag

SEQ ID NO: 9932 - DNA, 22 bp, Artificial Sequence
  Synthetic construct
gggggccgtaaggccctcgagc

SEQ ID NO: 9933 - DNA, 22 bp, Artificial Sequence
  Synthetic construct
ggggccgtaaggccctcgagca

SEQ ID NO: 9934 - DNA, 22 bp, Artificial Sequence
  Synthetic construct
gggccgtaaggccctcgagcat

SEQ ID NO: 9935 - DNA, 22 bp, Artificial Sequence
  Synthetic construct
ggccgtaaggccctcgagcatg

SEQ ID NO: 9936 - DNA, 22 bp, Artificial Sequence
  Synthetic construct
gccgtaaggccctcgagcatgt

SEQ ID NO: 9937 - DNA, 22 bp, Artificial Sequence
  Synthetic construct
ccgtaaggccctcgagcatgtt

SEQ ID NO: 9938 - DNA, 22 bp, Artificial Sequence
  Synthetic construct
cgtaaggccctcgagcatgtta

SEQ ID NO: 9939 - DNA, 22 bp, Artificial Sequence
  Synthetic construct
gtaaggccctcgagcatgttac

SEQ ID NO: 9940 - DNA, 22 bp, Artificial Sequence
  Synthetic construct
taaggccctcgagcatgttacc

SEQ ID NO: 9941 - DNA, 22 bp, Artificial Sequence
  Synthetic construct
aaggccctcgagcatgttacct

SEQ ID NO: 9942 - DNA, 22 bp, Artificial Sequence
  Synthetic construct
aggccctcgagcatgttaccta

SEQ ID NO: 9943 - DNA, 22 bp, Artificial Sequence
  Synthetic construct
ggccctcgagcatgttacctac

SEQ ID NO: 9944 - DNA, 22 bp, Artificial Sequence
  Synthetic construct
gccctcgagcatgttacctaca

SEQ ID NO: 9945 - DNA, 22 bp, Artificial Sequence
  Synthetic construct
ccctcgagcatgttacctacag

SEQ ID NO: 9946 - DNA, 22 bp, Artificial Sequence
  Synthetic construct
cctcgagcatgttacctacagg

SEQ ID NO: 9947 - DNA, 22 bp, Artificial Sequence
  Synthetic construct
ctcgagcatgttacctacaggt

SEQ ID NO: 9948 - DNA, 22 bp, Artificial Sequence
  Synthetic construct
tcgagcatgttacctacaggta

SEQ ID NO: 9949 - DNA, 22 bp, Artificial Sequence
  Synthetic construct
cgagcatgttacctacaggtag

SEQ ID NO: 9950 - DNA, 22 bp, Artificial Sequence
  Synthetic construct
gagcatgttacctacaggtagg

SEQ ID NO: 9951 - DNA, 22 bp, Artificial Sequence
  Synthetic construct
agcatgttacctacaggtagga

SEQ ID NO: 9952 - DNA, 22 bp, Artificial Sequence
  Synthetic construct
gcatgttacctacaggtaggag

SEQ ID NO: 9953 - DNA, 22 bp, Artificial Sequence
  Synthetic construct
catgttacctacaggtaggagc

SEQ ID NO: 9954 - DNA, 22 bp, Artificial Sequence
  Synthetic construct
atgttacctacaggtaggagcc

SEQ ID NO: 9955 - DNA, 22 bp, Artificial Sequence
  Synthetic construct
tgttacctacaggtaggagcca

SEQ ID NO: 9956 - DNA, 22 bp, Artificial Sequence
  Synthetic construct
gttacctacaggtaggagccag

SEQ ID NO: 9957 - DNA, 22 bp, Artificial Sequence
  Synthetic construct
ttacctacaggtaggagccagt

SEQ ID NO: 9958 - DNA, 22 bp, Artificial Sequence
  Synthetic construct
tacctacaggtaggagccagtc

SEQ ID NO: 9959 - DNA, 22 bp, Artificial Sequence
  Synthetic construct
acctacaggtaggagccagtcg

SEQ ID NO: 9960 - DNA, 22 bp, Artificial Sequence
  Synthetic construct
cctacaggtaggagccagtcga

SEQ ID NO: 9961 - DNA, 22 bp, Artificial Sequence
  Synthetic construct
ctacaggtaggagccagtcgac

SEQ ID NO: 9962 - DNA, 22 bp, Artificial Sequence
  Synthetic construct
tacaggtaggagccagtcgaca

SEQ ID NO: 9963 - DNA, 22 bp, Artificial Sequence
  Synthetic construct
acaggtaggagccagtcgacaa

SEQ ID NO: 9964 - DNA, 22 bp, Artificial Sequence
  Synthetic construct
caggtaggagccagtcgacaac

SEQ ID NO: 9965 - DNA, 22 bp, Artificial Sequence
  Synthetic construct
aggtaggagccagtcgacaacg

SEQ ID NO: 9966 - DNA, 22 bp, Artificial Sequence
  Synthetic construct
ggtaggagccagtcgacaacga

SEQ ID NO: 9967 - DNA, 22 bp, Artificial Sequence
  Synthetic construct
gtaggagccagtcgacaacgaa

SEQ ID NO: 9968 - DNA, 22 bp, Artificial Sequence
  Synthetic construct
taggagccagtcgacaacgaat

SEQ ID NO: 9969 - DNA, 22 bp, Artificial Sequence
  Synthetic construct
aggagccagtcgacaacgaatg

SEQ ID NO: 9970 - DNA, 22 bp, Artificial Sequence
  Synthetic construct
ggagccagtcgacaacgaatga

SEQ ID NO: 9971 - DNA, 22 bp, Artificial Sequence
  Synthetic construct
gagccagtcgacaacgaatgag

SEQ ID NO: 9972 - DNA, 22 bp, Artificial Sequence
  Synthetic construct
agccagtcgacaacgaatgaga

SEQ ID NO: 9973 - DNA, 22 bp, Artificial Sequence
  Synthetic construct
gccagtcgacaacgaatgagaa

SEQ ID NO: 9974 - DNA, 22 bp, Artificial Sequence
  Synthetic construct
ccagtcgacaacgaatgagaaa

SEQ ID NO: 9975 - DNA, 22 bp, Artificial Sequence
  Synthetic construct
cagtcgacaacgaatgagaaag

SEQ ID NO: 9976 - DNA, 22 bp, Artificial Sequence
  Synthetic construct
agtcgacaacgaatgagaaagg

SEQ ID NO: 9977 - DNA, 22 bp, Artificial Sequence
  Synthetic construct
gtcgacaacgaatgagaaaggc

SEQ ID NO: 9978 - DNA, 22 bp, Artificial Sequence
  Synthetic construct
tcgacaacgaatgagaaaggca

SEQ ID NO: 9979 - DNA, 22 bp, Artificial Sequence
  Synthetic construct
cgacaacgaatgagaaaggcac

SEQ ID NO: 9980 - DNA, 22 bp, Artificial Sequence
  Synthetic construct
gacaacgaatgagaaaggcacc

SEQ ID NO: 9981 - DNA, 22 bp, Artificial Sequence
  Synthetic construct
acaacgaatgagaaaggcacct

SEQ ID NO: 9982 - DNA, 22 bp, Artificial Sequence
  Synthetic construct
caacgaatgagaaaggcacctt

SEQ ID NO: 9983 - DNA, 22 bp, Artificial Sequence
  Synthetic construct
aacgaatgagaaaggcaccttt

SEQ ID NO: 9984 - DNA, 22 bp, Artificial Sequence
  Synthetic construct
acgaatgagaaaggcacctttt

SEQ ID NO: 9985 - DNA, 22 bp, Artificial Sequence
  Synthetic construct
cgaatgagaaaggcaccttttc

SEQ ID NO: 9986 - DNA, 22 bp, Artificial Sequence
  Synthetic construct
gaatgagaaaggcaccttttcc

SEQ ID NO: 9987 - DNA, 22 bp, Artificial Sequence
  Synthetic construct
aatgagaaaggcaccttttccc

SEQ ID NO: 9988 - DNA, 22 bp, Artificial Sequence
  Synthetic construct
atgagaaaggcaccttttccca

SEQ ID NO: 9989 - DNA, 22 bp, Artificial Sequence
  Synthetic construct
tgagaaaggcaccttttcccac

SEQ ID NO: 9990 - DNA, 22 bp, Artificial Sequence
  Synthetic construct
gagaaaggcaccttttcccaca

SEQ ID NO: 9991 - DNA, 22 bp, Artificial Sequence
  Synthetic construct
agaaaggcaccttttcccacac

SEQ ID NO: 9992 - DNA, 22 bp, Artificial Sequence
  Synthetic construct
gaaaggcaccttttcccacact

SEQ ID NO: 9993 - DNA, 22 bp, Artificial Sequence
  Synthetic construct
aaaggcaccttttcccacacta

SEQ ID NO: 9994 - DNA, 22 bp, Artificial Sequence
  Synthetic construct
aaggcaccttttcccacactat

SEQ ID NO: 9995 - DNA, 22 bp, Artificial Sequence
  Synthetic construct
aggcaccttttcccacactata

SEQ ID NO: 9996 - DNA, 22 bp, Artificial Sequence
  Synthetic construct
ggcaccttttcccacactatac

SEQ ID NO: 9997 - DNA, 22 bp, Artificial Sequence
  Synthetic construct
gcaccttttcccacactatacc

SEQ ID NO: 9998 - DNA, 22 bp, Artificial Sequence
  Synthetic construct
caccttttcccacactatacct

SEQ ID NO: 9999 - DNA, 22 bp, Artificial Sequence
  Synthetic construct
accttttcccacactataccta

SEQ ID NO: 10000 - DNA, 22 bp, Artificial Sequence
  Synthetic construct
ccttttcccacactatacctag

SEQ ID NO: 10001 - DNA, 22 bp, Artificial Sequence
  Synthetic construct
cttttcccacactatacctagt

SEQ ID NO: 10002 - DNA, 22 bp, Artificial Sequence
  Synthetic construct
ttttcccacactatacctagtg

SEQ ID NO: 10003 - DNA, 22 bp, Artificial Sequence
  Synthetic construct
tttcccacactatacctagtgg

SEQ ID NO: 10004 - DNA, 22 bp, Artificial Sequence
  Synthetic construct
ttcccacactatacctagtggg

SEQ ID NO: 10005 - DNA, 22 bp, Artificial Sequence
  Synthetic construct
tcccacactatacctagtgggt

SEQ ID NO: 10006 - DNA, 22 bp, Artificial Sequence
  Synthetic construct
cccacactatacctagtgggtt

SEQ ID NO: 10007 - DNA, 22 bp, Artificial Sequence
  Synthetic construct
ccacactatacctagtgggttc

SEQ ID NO: 10008 - DNA, 22 bp, Artificial Sequence
  Synthetic construct
cacactatacctagtgggttca

SEQ ID NO: 10009 - DNA, 22 bp, Artificial Sequence
  Synthetic construct
acactatacctagtgggttcaa

SEQ ID NO: 10010 - DNA, 22 bp, Artificial Sequence
  Synthetic construct
cactatacctagtgggttcaag

SEQ ID NO: 10011 - DNA, 22 bp, Artificial Sequence
  Synthetic construct
actatacctagtgggttcaaga

SEQ ID NO: 10012 - DNA, 22 bp, Artificial Sequence
  Synthetic construct
ctatacctagtgggttcaagat

SEQ ID NO: 10013 - DNA, 22 bp, Artificial Sequence
  Synthetic construct
tatacctagtgggttcaagata

SEQ ID NO: 10014 - DNA, 22 bp, Artificial Sequence
  Synthetic construct
atacctagtgggttcaagatac

SEQ ID NO: 10015 - DNA, 22 bp, Artificial Sequence
  Synthetic construct
tacctagtgggttcaagatacc

SEQ ID NO: 10016 - DNA, 22 bp, Artificial Sequence
  Synthetic construct
acctagtgggttcaagatacct

SEQ ID NO: 10017 - DNA, 22 bp, Artificial Sequence
  Synthetic construct
cctagtgggttcaagataccta

SEQ ID NO: 10018 - DNA, 22 bp, Artificial Sequence
  Synthetic construct
ctagtgggttcaagatacctag

SEQ ID NO: 10019 - DNA, 22 bp, Artificial Sequence
  Synthetic construct
tagtgggttcaagatacctaga

SEQ ID NO: 10020 - DNA, 22 bp, Artificial Sequence
  Synthetic construct
agtgggttcaagatacctagag

SEQ ID NO: 10021 - DNA, 22 bp, Artificial Sequence
  Synthetic construct
gtgggttcaagatacctagaga

SEQ ID NO: 10022 - DNA, 22 bp, Artificial Sequence
  Synthetic construct
tgggttcaagatacctagagac

SEQ ID NO: 10023 - DNA, 22 bp, Artificial Sequence
  Synthetic construct
gggttcaagatacctagagacg

SEQ ID NO: 10024 - DNA, 22 bp, Artificial Sequence
  Synthetic construct
ggttcaagatacctagagacga

SEQ ID NO: 10025 - DNA, 22 bp, Artificial Sequence
  Synthetic construct
gttcaagatacctagagacgac

SEQ ID NO: 10026 - DNA, 22 bp, Artificial Sequence
  Synthetic construct
ttcaagatacctagagacgaca

SEQ ID NO: 10027 - DNA, 22 bp, Artificial Sequence
  Synthetic construct
tcaagatacctagagacgacaa

SEQ ID NO: 10028 - DNA, 22 bp, Artificial Sequence
  Synthetic construct
caagatacctagagacgacaac

SEQ ID NO: 10029 - DNA, 22 bp, Artificial Sequence
  Synthetic construct
aagatacctagagacgacaacc

SEQ ID NO: 10030 - DNA, 22 bp, Artificial Sequence
  Synthetic construct
agatacctagagacgacaacca

SEQ ID NO: 10031 - DNA, 22 bp, Artificial Sequence
  Synthetic construct
gatacctagagacgacaaccat

SEQ ID NO: 10032 - DNA, 22 bp, Artificial Sequence
  Synthetic construct
atacctagagacgacaaccatg

SEQ ID NO: 10033 - DNA, 22 bp, Artificial Sequence
  Synthetic construct
tacctagagacgacaaccatgc

SEQ ID NO: 10034 - DNA, 22 bp, Artificial Sequence
  Synthetic construct
acctagagacgacaaccatgcc

SEQ ID NO: 10035 - DNA, 22 bp, Artificial Sequence
  Synthetic construct
cctagagacgacaaccatgcca

SEQ ID NO: 10036 - DNA, 22 bp, Artificial Sequence
  Synthetic construct
ctagagacgacaaccatgccaa

SEQ ID NO: 10037 - DNA, 22 bp, Artificial Sequence
  Synthetic construct
tagagacgacaaccatgccaaa

SEQ ID NO: 10038 - DNA, 22 bp, Artificial Sequence
  Synthetic construct
agagacgacaaccatgccaaac

SEQ ID NO: 10039 - DNA, 22 bp, Artificial Sequence
  Synthetic construct
gagacgacaaccatgccaaacg

SEQ ID NO: 10040 - DNA, 22 bp, Artificial Sequence
  Synthetic construct
agacgacaaccatgccaaacgt

SEQ ID NO: 10041 - DNA, 22 bp, Artificial Sequence
  Synthetic construct
gacgacaaccatgccaaacgtg

SEQ ID NO: 10042 - DNA, 22 bp, Artificial Sequence
  Synthetic construct
acgacaaccatgccaaacgtgc

SEQ ID NO: 10043 - DNA, 22 bp, Artificial Sequence
  Synthetic construct
cgacaaccatgccaaacgtgca

SEQ ID NO: 10044 - DNA, 22 bp, Artificial Sequence
  Synthetic construct
gacaaccatgccaaacgtgcat

SEQ ID NO: 10045 - DNA, 22 bp, Artificial Sequence
  Synthetic construct
acaaccatgccaaacgtgcatc

SEQ ID NO: 10046 - DNA, 22 bp, Artificial Sequence
  Synthetic construct
caaccatgccaaacgtgcatcg

SEQ ID NO: 10047 - DNA, 22 bp, Artificial Sequence
  Synthetic construct
aaccatgccaaacgtgcatcgt

SEQ ID NO: 10048 - DNA, 22 bp, Artificial Sequence
  Synthetic construct
accatgccaaacgtgcatcgtt

SEQ ID NO: 10049 - DNA, 22 bp, Artificial Sequence
  Synthetic construct
ccatgccaaacgtgcatcgttt

SEQ ID NO: 10050 - DNA, 22 bp, Artificial Sequence
  Synthetic construct
catgccaaacgtgcatcgttta

SEQ ID NO: 10051 - DNA, 22 bp, Artificial Sequence
  Synthetic construct
atgccaaacgtgcatcgtttat

SEQ ID NO: 10052 - DNA, 22 bp, Artificial Sequence
  Synthetic construct
tgccaaacgtgcatcgtttatg

SEQ ID NO: 10053 - DNA, 22 bp, Artificial Sequence
  Synthetic construct
gccaaacgtgcatcgtttatgt

SEQ ID NO: 10054 - DNA, 22 bp, Artificial Sequence
  Synthetic construct
ccaaacgtgcatcgtttatgta

SEQ ID NO: 10055 - DNA, 22 bp, Artificial Sequence
  Synthetic construct
caaacgtgcatcgtttatgtaa

SEQ ID NO: 10056 - DNA, 22 bp, Artificial Sequence
  Synthetic construct
aaacgtgcatcgtttatgtaaa

SEQ ID NO: 10057 - DNA, 22 bp, Artificial Sequence
  Synthetic construct
aacgtgcatcgtttatgtaaaa

SEQ ID NO: 10058 - DNA, 22 bp, Artificial Sequence
  Synthetic construct
acgtgcatcgtttatgtaaaac

SEQ ID NO: 10059 - DNA, 22 bp, Artificial Sequence
  Synthetic construct
cgtgcatcgtttatgtaaaacc

SEQ ID NO: 10060 - DNA, 22 bp, Artificial Sequence
  Synthetic construct
gtgcatcgtttatgtaaaacca

SEQ ID NO: 10061 - DNA, 22 bp, Artificial Sequence
  Synthetic construct
tgcatcgtttatgtaaaaccat

SEQ ID NO: 10062 - DNA, 22 bp, Artificial Sequence
  Synthetic construct
gcatcgtttatgtaaaaccata

SEQ ID NO: 10063 - DNA, 22 bp, Artificial Sequence
  Synthetic construct
catcgtttatgtaaaaccatat

SEQ ID NO: 10064 - DNA, 22 bp, Artificial Sequence
  Synthetic construct
atcgtttatgtaaaaccatatc

SEQ ID NO: 10065 - DNA, 22 bp, Artificial Sequence
  Synthetic construct
tcgtttatgtaaaaccatatca

SEQ ID NO: 10066 - DNA, 22 bp, Artificial Sequence
  Synthetic construct
cgtttatgtaaaaccatatcac

SEQ ID NO: 10067 - DNA, 22 bp, Artificial Sequence
  Synthetic construct
gtttatgtaaaaccatatcacg

SEQ ID NO: 10068 - DNA, 22 bp, Artificial Sequence
  Synthetic construct
tttatgtaaaaccatatcacga

SEQ ID NO: 10069 - DNA, 22 bp, Artificial Sequence
  Synthetic construct
ttatgtaaaaccatatcacgat

SEQ ID NO: 10070 - DNA, 22 bp, Artificial Sequence
  Synthetic construct
tatgtaaaaccatatcacgata

SEQ ID NO: 10071 - DNA, 22 bp, Artificial Sequence
  Synthetic construct
atgtaaaaccatatcacgatac

SEQ ID NO: 10072 - DNA, 22 bp, Artificial Sequence
  Synthetic construct
tgtaaaaccatatcacgatacg

SEQ ID NO: 10073 - DNA, 22 bp, Artificial Sequence
  Synthetic construct
gtaaaaccatatcacgatacgt

SEQ ID NO: 10074 - DNA, 22 bp, Artificial Sequence
  Synthetic construct
taaaaccatatcacgatacgtc

SEQ ID NO: 10075 - DNA, 22 bp, Artificial Sequence
  Synthetic construct
aaaaccatatcacgatacgtcg

SEQ ID NO: 10076 - DNA, 22 bp, Artificial Sequence
  Synthetic construct
aaaccatatcacgatacgtcgc

SEQ ID NO: 10077 - DNA, 22 bp, Artificial Sequence
  Synthetic construct
aaccatatcacgatacgtcgcg

SEQ ID NO: 10078 - DNA, 22 bp, Artificial Sequence
  Synthetic construct
accatatcacgatacgtcgcga

SEQ ID NO: 10079 - DNA, 22 bp, Artificial Sequence
  Synthetic construct
ccatatcacgatacgtcgcgat

SEQ ID NO: 10080 - DNA, 22 bp, Artificial Sequence
  Synthetic construct
catatcacgatacgtcgcgata

SEQ ID NO: 10081 - DNA, 22 bp, Artificial Sequence
  Synthetic construct
atatcacgatacgtcgcgatat

SEQ ID NO: 10082 - DNA, 22 bp, Artificial Sequence
  Synthetic construct
tatcacgatacgtcgcgatatg

SEQ ID NO: 10083 - DNA, 22 bp, Artificial Sequence
  Synthetic construct
atcacgatacgtcgcgatatgt

SEQ ID NO: 10084 - DNA, 22 bp, Artificial Sequence
  Synthetic construct
tcacgatacgtcgcgatatgtt

SEQ ID NO: 10085 - DNA, 22 bp, Artificial Sequence
  Synthetic construct
cacgatacgtcgcgatatgttg

SEQ ID NO: 10086 - DNA, 22 bp, Artificial Sequence
  Synthetic construct
acgatacgtcgcgatatgttgc

SEQ ID NO: 10087 - DNA, 22 bp, Artificial Sequence
  Synthetic construct
cgatacgtcgcgatatgttgca

SEQ ID NO: 10088 - DNA, 22 bp, Artificial Sequence
  Synthetic construct
gatacgtcgcgatatgttgcac

SEQ ID NO: 10089 - DNA, 22 bp, Artificial Sequence
  Synthetic construct
atacgtcgcgatatgttgcacg

SEQ ID NO: 10090 - DNA, 22 bp, Artificial Sequence
  Synthetic construct
tacgtcgcgatatgttgcacgt

SEQ ID NO: 10091 - DNA, 22 bp, Artificial Sequence
  Synthetic construct
acgtcgcgatatgttgcacgtt

SEQ ID NO: 10092 - DNA, 22 bp, Artificial Sequence
  Synthetic construct
cgtcgcgatatgttgcacgttg

SEQ ID NO: 10093 - DNA, 22 bp, Artificial Sequence
  Synthetic construct
gtcgcgatatgttgcacgttgt

SEQ ID NO: 10094 - DNA, 22 bp, Artificial Sequence
  Synthetic construct
tcgcgatatgttgcacgttgtc

SEQ ID NO: 10095 - DNA, 22 bp, Artificial Sequence
  Synthetic construct
cgcgatatgttgcacgttgtct

SEQ ID NO: 10096 - DNA, 22 bp, Artificial Sequence
  Synthetic construct
gcgatatgttgcacgttgtctg

SEQ ID NO: 10097 - DNA, 22 bp, Artificial Sequence
  Synthetic construct
cgatatgttgcacgttgtctgg

SEQ ID NO: 10098 - DNA, 22 bp, Artificial Sequence
  Synthetic construct
gatatgttgcacgttgtctgga

SEQ ID NO: 10099 - DNA, 22 bp, Artificial Sequence
  Synthetic construct
atatgttgcacgttgtctggaa

SEQ ID NO: 10100 - DNA, 22 bp, Artificial Sequence
  Synthetic construct
tatgttgcacgttgtctggaag

SEQ ID NO: 10101 - DNA, 22 bp, Artificial Sequence
  Synthetic construct
atgttgcacgttgtctggaagt

SEQ ID NO: 10102 - DNA, 22 bp, Artificial Sequence
  Synthetic construct
tgttgcacgttgtctggaagtt

SEQ ID NO: 10103 - DNA, 22 bp, Artificial Sequence
  Synthetic construct
gttgcacgttgtctggaagttt

SEQ ID NO: 10104 - DNA, 22 bp, Artificial Sequence
  Synthetic construct
ttgcacgttgtctggaagtttg

SEQ ID NO: 10105 - DNA, 22 bp, Artificial Sequence
  Synthetic construct
tgcacgttgtctggaagtttgc

SEQ ID NO: 10106 - DNA, 22 bp, Artificial Sequence
  Synthetic construct
gcacgttgtctggaagtttgca

SEQ ID NO: 10107 - DNA, 22 bp, Artificial Sequence
  Synthetic construct
cacgttgtctggaagtttgcag

SEQ ID NO: 10108 - DNA, 22 bp, Artificial Sequence
  Synthetic construct
acgttgtctggaagtttgcagc

SEQ ID NO: 10109 - DNA, 22 bp, Artificial Sequence
  Synthetic construct
cgttgtctggaagtttgcagct

SEQ ID NO: 10110 - DNA, 22 bp, Artificial Sequence
  Synthetic construct
gttgtctggaagtttgcagctg

SEQ ID NO: 10111 - DNA, 22 bp, Artificial Sequence
  Synthetic construct
ttgtctggaagtttgcagctgg

SEQ ID NO: 10112 - DNA, 22 bp, Artificial Sequence
  Synthetic construct
tgtctggaagtttgcagctgga

SEQ ID NO: 10113 - DNA, 22 bp, Artificial Sequence
  Synthetic construct
gtctggaagtttgcagctggat

SEQ ID NO: 10114 - DNA, 22 bp, Artificial Sequence
  Synthetic construct
tctggaagtttgcagctggata

SEQ ID NO: 10115 - DNA, 22 bp, Artificial Sequence
  Synthetic construct
ctggaagtttgcagctggatac

SEQ ID NO: 10116 - DNA, 22 bp, Artificial Sequence
  Synthetic construct
tggaagtttgcagctggatacg

SEQ ID NO: 10117 - DNA, 22 bp, Artificial Sequence
  Synthetic construct
ggaagtttgcagctggatacga

SEQ ID NO: 10118 - DNA, 22 bp, Artificial Sequence
  Synthetic construct
gaagtttgcagctggatacgac

SEQ ID NO: 10119 - DNA, 22 bp, Artificial Sequence
  Synthetic construct
aagtttgcagctggatacgaca

SEQ ID NO: 10120 - DNA, 22 bp, Artificial Sequence
  Synthetic construct
agtttgcagctggatacgacag

SEQ ID NO: 10121 - DNA, 22 bp, Artificial Sequence
  Synthetic construct
gtttgcagctggatacgacaga

SEQ ID NO: 10122 - DNA, 22 bp, Artificial Sequence
  Synthetic construct
tttgcagctggatacgacagac

SEQ ID NO: 10123 - DNA, 22 bp, Artificial Sequence
  Synthetic construct
ttgcagctggatacgacagacg

SEQ ID NO: 10124 - DNA, 22 bp, Artificial Sequence
  Synthetic construct
tgcagctggatacgacagacgg

SEQ ID NO: 10125 - DNA, 22 bp, Artificial Sequence
  Synthetic construct
gcagctggatacgacagacggc

SEQ ID NO: 10126 - DNA, 22 bp, Artificial Sequence
  Synthetic construct
cagctggatacgacagacggcc

SEQ ID NO: 10127 - DNA, 22 bp, Artificial Sequence
  Synthetic construct
agctggatacgacagacggcca

SEQ ID NO: 10128 - DNA, 22 bp, Artificial Sequence
  Synthetic construct
gctggatacgacagacggccat

SEQ ID NO: 10129 - DNA, 22 bp, Artificial Sequence
  Synthetic construct
ctggatacgacagacggccatc

SEQ ID NO: 10130 - DNA, 22 bp, Artificial Sequence
  Synthetic construct
tggatacgacagacggccatct

SEQ ID NO: 10131 - DNA, 22 bp, Artificial Sequence
  Synthetic construct
ggatacgacagacggccatcta

SEQ ID NO: 10132 - DNA, 22 bp, Artificial Sequence
  Synthetic construct
gatacgacagacggccatctaa

SEQ ID NO: 10133 - DNA, 22 bp, Artificial Sequence
  Synthetic construct
atacgacagacggccatctaac

SEQ ID NO: 10134 - DNA, 22 bp, Artificial Sequence
  Synthetic construct
tacgacagacggccatctaact

SEQ ID NO: 10135 - DNA, 22 bp, Artificial Sequence
  Synthetic construct
acgacagacggccatctaactt

SEQ ID NO: 10136 - DNA, 22 bp, Artificial Sequence
  Synthetic construct
cgacagacggccatctaacttg

SEQ ID NO: 10137 - DNA, 22 bp, Artificial Sequence
  Synthetic construct
gacagacggccatctaacttga

SEQ ID NO: 10138 - DNA, 22 bp, Artificial Sequence
  Synthetic construct
acagacggccatctaacttgat

SEQ ID NO: 10139 - DNA, 22 bp, Artificial Sequence
  Synthetic construct
cagacggccatctaacttgatg

SEQ ID NO: 10140 - DNA, 22 bp, Artificial Sequence
  Synthetic construct
agacggccatctaacttgatgt

SEQ ID NO: 10141 - DNA, 22 bp, Artificial Sequence
  Synthetic construct
gacggccatctaacttgatgtt

SEQ ID NO: 10142 - DNA, 22 bp, Artificial Sequence
  Synthetic construct
acggccatctaacttgatgtta

SEQ ID NO: 10143 - DNA, 22 bp, Artificial Sequence
  Synthetic construct
cggccatctaacttgatgttag

SEQ ID NO: 10144 - DNA, 22 bp, Artificial Sequence
  Synthetic construct
ggccatctaacttgatgttagt

SEQ ID NO: 10145 - DNA, 22 bp, Artificial Sequence
  Synthetic construct
gccatctaacttgatgttagta

SEQ ID NO: 10146 - DNA, 22 bp, Artificial Sequence
  Synthetic construct
ccatctaacttgatgttagtac

SEQ ID NO: 10147 - DNA, 22 bp, Artificial Sequence
  Synthetic construct
catctaacttgatgttagtacc

SEQ ID NO: 10148 - DNA, 22 bp, Artificial Sequence
  Synthetic construct
atctaacttgatgttagtaccg

SEQ ID NO: 10149 - DNA, 22 bp, Artificial Sequence
  Synthetic construct
tctaacttgatgttagtaccga

SEQ ID NO: 10150 - DNA, 22 bp, Artificial Sequence
  Synthetic construct
ctaacttgatgttagtaccgac

SEQ ID NO: 10151 - DNA, 22 bp, Artificial Sequence
  Synthetic construct
taacttgatgttagtaccgacc

SEQ ID NO: 10152 - DNA, 22 bp, Artificial Sequence
  Synthetic construct
aacttgatgttagtaccgacct

SEQ ID NO: 10153 - DNA, 22 bp, Artificial Sequence
  Synthetic construct
acttgatgttagtaccgacctg

SEQ ID NO: 10154 - DNA, 22 bp, Artificial Sequence
  Synthetic construct
cttgatgttagtaccgacctga

SEQ ID NO: 10155 - DNA, 22 bp, Artificial Sequence
  Synthetic construct
ttgatgttagtaccgacctgac

SEQ ID NO: 10156 - DNA, 22 bp, Artificial Sequence
  Synthetic construct
tgatgttagtaccgacctgacg

SEQ ID NO: 10157 - DNA, 22 bp, Artificial Sequence
  Synthetic construct
gatgttagtaccgacctgacgt

SEQ ID NO: 10158 - DNA, 22 bp, Artificial Sequence
  Synthetic construct
atgttagtaccgacctgacgta

SEQ ID NO: 10159 - DNA, 22 bp, Artificial Sequence
  Synthetic construct
tgttagtaccgacctgacgtac

SEQ ID NO: 10160 - DNA, 22 bp, Artificial Sequence
  Synthetic construct
gttagtaccgacctgacgtacg

SEQ ID NO: 10161 - DNA, 22 bp, Artificial Sequence
  Synthetic construct
ttagtaccgacctgacgtacgg

SEQ ID NO: 10162 - DNA, 22 bp, Artificial Sequence
  Synthetic construct
tagtaccgacctgacgtacggc

SEQ ID NO: 10163 - DNA, 22 bp, Artificial Sequence
  Synthetic construct
agtaccgacctgacgtacggct

SEQ ID NO: 10164 - DNA, 22 bp, Artificial Sequence
  Synthetic construct
gtaccgacctgacgtacggctc

SEQ ID NO: 10165 - DNA, 22 bp, Artificial Sequence
  Synthetic construct
taccgacctgacgtacggctct

SEQ ID NO: 10166 - DNA, 22 bp, Artificial Sequence
  Synthetic construct
accgacctgacgtacggctctc

SEQ ID NO: 10167 - DNA, 22 bp, Artificial Sequence
  Synthetic construct
ccgacctgacgtacggctctca

SEQ ID NO: 10168 - DNA, 22 bp, Artificial Sequence
  Synthetic construct
cgacctgacgtacggctctcat

SEQ ID NO: 10169 - DNA, 22 bp, Artificial Sequence
  Synthetic construct
gacctgacgtacggctctcata

SEQ ID NO: 10170 - DNA, 22 bp, Artificial Sequence
  Synthetic construct
acctgacgtacggctctcatag

SEQ ID NO: 10171 - DNA, 22 bp, Artificial Sequence
  Synthetic construct
cctgacgtacggctctcatagg

SEQ ID NO: 10172 - DNA, 22 bp, Artificial Sequence
  Synthetic construct
ctgacgtacggctctcatagga

SEQ ID NO: 10173 - DNA, 22 bp, Artificial Sequence
  Synthetic construct
tgacgtacggctctcataggaa

SEQ ID NO: 10174 - DNA, 22 bp, Artificial Sequence
  Synthetic construct
gacgtacggctctcataggaag

SEQ ID NO: 10175 - DNA, 22 bp, Artificial Sequence
  Synthetic construct
acgtacggctctcataggaaga

SEQ ID NO: 10176 - DNA, 22 bp, Artificial Sequence
  Synthetic construct
cgtacggctctcataggaagaa

SEQ ID NO: 10177 - DNA, 22 bp, Artificial Sequence
  Synthetic construct
gtacggctctcataggaagaaa

SEQ ID NO: 10178 - DNA, 22 bp, Artificial Sequence
  Synthetic construct
tacggctctcataggaagaaac

SEQ ID NO: 10179 - DNA, 22 bp, Artificial Sequence
  Synthetic construct
acggctctcataggaagaaact

SEQ ID NO: 10180 - DNA, 22 bp, Artificial Sequence
  Synthetic construct
cggctctcataggaagaaactc

SEQ ID NO: 10181 - DNA, 22 bp, Artificial Sequence
  Synthetic construct
ggctctcataggaagaaactct

SEQ ID NO: 10182 - DNA, 22 bp, Artificial Sequence
  Synthetic construct
gctctcataggaagaaactctt

SEQ ID NO: 10183 - DNA, 22 bp, Artificial Sequence
  Synthetic construct
ctctcataggaagaaactcttg

SEQ ID NO: 10184 - DNA, 22 bp, Artificial Sequence
  Synthetic construct
tctcataggaagaaactcttga

SEQ ID NO: 10185 - DNA, 22 bp, Artificial Sequence
  Synthetic construct
ctcataggaagaaactcttgaa

SEQ ID NO: 10186 - DNA, 22 bp, Artificial Sequence
  Synthetic construct
tcataggaagaaactcttgaag

SEQ ID NO: 10187 - DNA, 22 bp, Artificial Sequence
  Synthetic construct
cataggaagaaactcttgaagg

SEQ ID NO: 10188 - DNA, 22 bp, Artificial Sequence
  Synthetic construct
ataggaagaaactcttgaaggt

SEQ ID NO: 10189 - DNA, 22 bp, Artificial Sequence
  Synthetic construct
taggaagaaactcttgaaggtg

SEQ ID NO: 10190 - DNA, 22 bp, Artificial Sequence
  Synthetic construct
aggaagaaactcttgaaggtga

SEQ ID NO: 10191 - DNA, 22 bp, Artificial Sequence
  Synthetic construct
ggaagaaactcttgaaggtgaa

SEQ ID NO: 10192 - DNA, 22 bp, Artificial Sequence
  Synthetic construct
gaagaaactcttgaaggtgaac

SEQ ID NO: 10193 - DNA, 22 bp, Artificial Sequence
  Synthetic construct
aagaaactcttgaaggtgaacc

SEQ ID NO: 10194 - DNA, 22 bp, Artificial Sequence
  Synthetic construct
agaaactcttgaaggtgaacct

SEQ ID NO: 10195 - DNA, 22 bp, Artificial Sequence
  Synthetic construct
gaaactcttgaaggtgaacctt

SEQ ID NO: 10196 - DNA, 22 bp, Artificial Sequence
  Synthetic construct
aaactcttgaaggtgaaccttc

SEQ ID NO: 10197 - DNA, 22 bp, Artificial Sequence
  Synthetic construct
aactcttgaaggtgaaccttcg

SEQ ID NO: 10198 - DNA, 22 bp, Artificial Sequence
  Synthetic construct
actcttgaaggtgaaccttcgt

SEQ ID NO: 10199 - DNA, 22 bp, Artificial Sequence
  Synthetic construct
ctcttgaaggtgaaccttcgta

SEQ ID NO: 10200 - DNA, 22 bp, Artificial Sequence
  Synthetic construct
tcttgaaggtgaaccttcgtaa

SEQ ID NO: 10201 - DNA, 22 bp, Artificial Sequence
  Synthetic construct
cttgaaggtgaaccttcgtaag

SEQ ID NO: 10202 - DNA, 22 bp, Artificial Sequence
  Synthetic construct
ttgaaggtgaaccttcgtaagc

SEQ ID NO: 10203 - DNA, 22 bp, Artificial Sequence
  Synthetic construct
tgaaggtgaaccttcgtaagca

SEQ ID NO: 10204 - DNA, 22 bp, Artificial Sequence
  Synthetic construct
gaaggtgaaccttcgtaagcat

SEQ ID NO: 10205 - DNA, 22 bp, Artificial Sequence
  Synthetic construct
aaggtgaaccttcgtaagcatc

SEQ ID NO: 10206 - DNA, 22 bp, Artificial Sequence
  Synthetic construct
aggtgaaccttcgtaagcatct

SEQ ID NO: 10207 - DNA, 22 bp, Artificial Sequence
  Synthetic construct
ggtgaaccttcgtaagcatctc

SEQ ID NO: 10208 - DNA, 22 bp, Artificial Sequence
  Synthetic construct
gtgaaccttcgtaagcatctca

SEQ ID NO: 10209 - DNA, 22 bp, Artificial Sequence
  Synthetic construct
tgaaccttcgtaagcatctcat

SEQ ID NO: 10210 - DNA, 22 bp, Artificial Sequence
  Synthetic construct
gaaccttcgtaagcatctcata

SEQ ID NO: 10211 - DNA, 22 bp, Artificial Sequence
  Synthetic construct
aaccttcgtaagcatctcatat

SEQ ID NO: 10212 - DNA, 22 bp, Artificial Sequence
  Synthetic construct
accttcgtaagcatctcatatg

SEQ ID NO: 10213 - DNA, 22 bp, Artificial Sequence
  Synthetic construct
ccttcgtaagcatctcatatgc

SEQ ID NO: 10214 - DNA, 22 bp, Artificial Sequence
  Synthetic construct
cttcgtaagcatctcatatgca

SEQ ID NO: 10215 - DNA, 22 bp, Artificial Sequence
  Synthetic construct
ttcgtaagcatctcatatgcac

SEQ ID NO: 10216 - DNA, 22 bp, Artificial Sequence
  Synthetic construct
tcgtaagcatctcatatgcacc

SEQ ID NO: 10217 - DNA, 22 bp, Artificial Sequence
  Synthetic construct
cgtaagcatctcatatgcaccc

SEQ ID NO: 10218 - DNA, 22 bp, Artificial Sequence
  Synthetic construct
gtaagcatctcatatgcaccct

SEQ ID NO: 10219 - DNA, 22 bp, Artificial Sequence
  Synthetic construct
taagcatctcatatgcaccctg

SEQ ID NO: 10220 - DNA, 22 bp, Artificial Sequence
  Synthetic construct
aagcatctcatatgcaccctgg

SEQ ID NO: 10221 - DNA, 22 bp, Artificial Sequence
  Synthetic construct
agcatctcatatgcaccctgga

SEQ ID NO: 10222 - DNA, 22 bp, Artificial Sequence
  Synthetic construct
gcatctcatatgcaccctggat

SEQ ID NO: 10223 - DNA, 22 bp, Artificial Sequence
  Synthetic construct
catctcatatgcaccctggata

SEQ ID NO: 10224 - DNA, 22 bp, Artificial Sequence
  Synthetic construct
atctcatatgcaccctggatat

SEQ ID NO: 10225 - DNA, 22 bp, Artificial Sequence
  Synthetic construct
tctcatatgcaccctggatatc

SEQ ID NO: 10226 - DNA, 22 bp, Artificial Sequence
  Synthetic construct
ctcatatgcaccctggatatca

SEQ ID NO: 10227 - DNA, 22 bp, Artificial Sequence
  Synthetic construct
tcatatgcaccctggatatcac

SEQ ID NO: 10228 - DNA, 22 bp, Artificial Sequence
  Synthetic construct
catatgcaccctggatatcact

SEQ ID NO: 10229 - DNA, 22 bp, Artificial Sequence
  Synthetic construct
atatgcaccctggatatcactc

SEQ ID NO: 10230 - DNA, 22 bp, Artificial Sequence
  Synthetic construct
tatgcaccctggatatcactca

SEQ ID NO: 10231 - DNA, 22 bp, Artificial Sequence
  Synthetic construct
atgcaccctggatatcactcat

SEQ ID NO: 10232 - DNA, 22 bp, Artificial Sequence
  Synthetic construct
tgcaccctggatatcactcatt

SEQ ID NO: 10233 - DNA, 22 bp, Artificial Sequence
  Synthetic construct
gcaccctggatatcactcatta

SEQ ID NO: 10234 - DNA, 22 bp, Artificial Sequence
  Synthetic construct
caccctggatatcactcattag

SEQ ID NO: 10235 - DNA, 22 bp, Artificial Sequence
  Synthetic construct
accctggatatcactcattagt

SEQ ID NO: 10236 - DNA, 22 bp, Artificial Sequence
  Synthetic construct
ccctggatatcactcattagtg

SEQ ID NO: 10237 - DNA, 22 bp, Artificial Sequence
  Synthetic construct
cctggatatcactcattagtgg

SEQ ID NO: 10238 - DNA, 22 bp, Artificial Sequence
  Synthetic construct
ctggatatcactcattagtggt

SEQ ID NO: 10239 - DNA, 22 bp, Artificial Sequence
  Synthetic construct
tggatatcactcattagtggta

SEQ ID NO: 10240 - DNA, 22 bp, Artificial Sequence
  Synthetic construct
ggatatcactcattagtggtaa

SEQ ID NO: 10241 - DNA, 22 bp, Artificial Sequence
  Synthetic construct
gatatcactcattagtggtaac

SEQ ID NO: 10242 - DNA, 22 bp, Artificial Sequence
  Synthetic construct
atatcactcattagtggtaacc

SEQ ID NO: 10243 - DNA, 22 bp, Artificial Sequence
  Synthetic construct
tatcactcattagtggtaacca

SEQ ID NO: 10244 - DNA, 22 bp, Artificial Sequence
  Synthetic construct
atcactcattagtggtaaccaa

SEQ ID NO: 10245 - DNA, 22 bp, Artificial Sequence
  Synthetic construct
tcactcattagtggtaaccaac

SEQ ID NO: 10246 - DNA, 22 bp, Artificial Sequence
  Synthetic construct
cactcattagtggtaaccaacc

SEQ ID NO: 10247 - DNA, 22 bp, Artificial Sequence
  Synthetic construct
actcattagtggtaaccaaccg

SEQ ID NO: 10248 - DNA, 22 bp, Artificial Sequence
  Synthetic construct
ctcattagtggtaaccaaccga

SEQ ID NO: 10249 - DNA, 22 bp, Artificial Sequence
  Synthetic construct
tcattagtggtaaccaaccgaa

SEQ ID NO: 10250 - DNA, 22 bp, Artificial Sequence
  Synthetic construct
cattagtggtaaccaaccgaac

SEQ ID NO: 10251 - DNA, 22 bp, Artificial Sequence
  Synthetic construct
attagtggtaaccaaccgaact

SEQ ID NO: 10252 - DNA, 22 bp, Artificial Sequence
  Synthetic construct
ttagtggtaaccaaccgaactg

SEQ ID NO: 10253 - DNA, 22 bp, Artificial Sequence
  Synthetic construct
tagtggtaaccaaccgaactgc

SEQ ID NO: 10254 - DNA, 22 bp, Artificial Sequence
  Synthetic construct
agtggtaaccaaccgaactgca

SEQ ID NO: 10255 - DNA, 22 bp, Artificial Sequence
  Synthetic construct
gtggtaaccaaccgaactgcaa

SEQ ID NO: 10256 - DNA, 22 bp, Artificial Sequence
  Synthetic construct
tggtaaccaaccgaactgcaac

SEQ ID NO: 10257 - DNA, 22 bp, Artificial Sequence
  Synthetic construct
ggtaaccaaccgaactgcaact

SEQ ID NO: 10258 - DNA, 22 bp, Artificial Sequence
  Synthetic construct
gtaaccaaccgaactgcaactc

SEQ ID NO: 10259 - DNA, 22 bp, Artificial Sequence
  Synthetic construct
taaccaaccgaactgcaactcc

SEQ ID NO: 10260 - DNA, 22 bp, Artificial Sequence
  Synthetic construct
aaccaaccgaactgcaactcca

SEQ ID NO: 10261 - DNA, 22 bp, Artificial Sequence
  Synthetic construct
accaaccgaactgcaactccaa

SEQ ID NO: 10262 - DNA, 22 bp, Artificial Sequence
  Synthetic construct
ccaaccgaactgcaactccaac

SEQ ID NO: 10263 - DNA, 22 bp, Artificial Sequence
  Synthetic construct
caaccgaactgcaactccaacc

SEQ ID NO: 10264 - DNA, 22 bp, Artificial Sequence
  Synthetic construct
aaccgaactgcaactccaacca

SEQ ID NO: 10265 - DNA, 22 bp, Artificial Sequence
  Synthetic construct
accgaactgcaactccaaccac

SEQ ID NO: 10266 - DNA, 22 bp, Artificial Sequence
  Synthetic construct
ccgaactgcaactccaaccacc

SEQ ID NO: 10267 - DNA, 22 bp, Artificial Sequence
  Synthetic construct
cgaactgcaactccaaccacct

SEQ ID NO: 10268 - DNA, 22 bp, Artificial Sequence
  Synthetic construct
gaactgcaactccaaccacctg

SEQ ID NO: 10269 - DNA, 22 bp, Artificial Sequence
  Synthetic construct
aactgcaactccaaccacctgc

SEQ ID NO: 10270 - DNA, 22 bp, Artificial Sequence
  Synthetic construct
actgcaactccaaccacctgcc

SEQ ID NO: 10271 - DNA, 22 bp, Artificial Sequence
  Synthetic construct
ctgcaactccaaccacctgccg

SEQ ID NO: 10272 - DNA, 22 bp, Artificial Sequence
  Synthetic construct
tgcaactccaaccacctgccgg

SEQ ID NO: 10273 - DNA, 22 bp, Artificial Sequence
  Synthetic construct
gcaactccaaccacctgccggc

SEQ ID NO: 10274 - DNA, 22 bp, Artificial Sequence
  Synthetic construct
caactccaaccacctgccggcc

SEQ ID NO: 10275 - DNA, 22 bp, Artificial Sequence
  Synthetic construct
aactccaaccacctgccggcca

SEQ ID NO: 10276 - DNA, 22 bp, Artificial Sequence
  Synthetic construct
actccaaccacctgccggccac

SEQ ID NO: 10277 - DNA, 22 bp, Artificial Sequence
  Synthetic construct
ctccaaccacctgccggccacg

SEQ ID NO: 10278 - DNA, 22 bp, Artificial Sequence
  Synthetic construct
tccaaccacctgccggccacgt

SEQ ID NO: 10279 - DNA, 22 bp, Artificial Sequence
  Synthetic construct
ccaaccacctgccggccacgtg

SEQ ID NO: 10280 - DNA, 22 bp, Artificial Sequence
  Synthetic construct
caaccacctgccggccacgtgt

SEQ ID NO: 10281 - DNA, 22 bp, Artificial Sequence
  Synthetic construct
aaccacctgccggccacgtgtt

SEQ ID NO: 10282 - DNA, 22 bp, Artificial Sequence
  Synthetic construct
accacctgccggccacgtgttt

SEQ ID NO: 10283 - DNA, 22 bp, Artificial Sequence
  Synthetic construct
ccacctgccggccacgtgtttt

SEQ ID NO: 10284 - DNA, 22 bp, Artificial Sequence
  Synthetic construct
cacctgccggccacgtgttttg

SEQ ID NO: 10285 - DNA, 22 bp, Artificial Sequence
  Synthetic construct
acctgccggccacgtgttttga

SEQ ID NO: 10286 - DNA, 22 bp, Artificial Sequence
  Synthetic construct
cctgccggccacgtgttttgat

SEQ ID NO: 10287 - DNA, 22 bp, Artificial Sequence
  Synthetic construct
ctgccggccacgtgttttgatc

SEQ ID NO: 10288 - DNA, 22 bp, Artificial Sequence
  Synthetic construct
tgccggccacgtgttttgatcg

SEQ ID NO: 10289 - DNA, 22 bp, Artificial Sequence
  Synthetic construct
gccggccacgtgttttgatcga

SEQ ID NO: 10290 - DNA, 22 bp, Artificial Sequence
  Synthetic construct
ccggccacgtgttttgatcgaa

SEQ ID NO: 10291 - DNA, 22 bp, Artificial Sequence
  Synthetic construct
cggccacgtgttttgatcgaaa

SEQ ID NO: 10292 - DNA, 22 bp, Artificial Sequence
  Synthetic construct
ggccacgtgttttgatcgaaac

SEQ ID NO: 10293 - DNA, 22 bp, Artificial Sequence
  Synthetic construct
gccacgtgttttgatcgaaact

SEQ ID NO: 10294 - DNA, 22 bp, Artificial Sequence
  Synthetic construct
ccacgtgttttgatcgaaactt

SEQ ID NO: 10295 - DNA, 22 bp, Artificial Sequence
  Synthetic construct
cacgtgttttgatcgaaacttt

SEQ ID NO: 10296 - DNA, 22 bp, Artificial Sequence
  Synthetic construct
acgtgttttgatcgaaactttc

SEQ ID NO: 10297 - DNA, 22 bp, Artificial Sequence
  Synthetic construct
cgtgttttgatcgaaactttcg

SEQ ID NO: 10298 - DNA, 22 bp, Artificial Sequence
  Synthetic construct
gtgttttgatcgaaactttcga

SEQ ID NO: 10299 - DNA, 22 bp, Artificial Sequence
  Synthetic construct
tgttttgatcgaaactttcgat

SEQ ID NO: 10300 - DNA, 22 bp, Artificial Sequence
  Synthetic construct
gttttgatcgaaactttcgatc

SEQ ID NO: 10301 - DNA, 22 bp, Artificial Sequence
  Synthetic construct
ttttgatcgaaactttcgatct

SEQ ID NO: 10302 - DNA, 22 bp, Artificial Sequence
  Synthetic construct
tttgatcgaaactttcgatctt

SEQ ID NO: 10303 - DNA, 22 bp, Artificial Sequence
  Synthetic construct
ttgatcgaaactttcgatcttc

SEQ ID NO: 10304 - DNA, 22 bp, Artificial Sequence
  Synthetic construct
tgatcgaaactttcgatcttcg

SEQ ID NO: 10305 - DNA, 22 bp, Artificial Sequence
  Synthetic construct
gatcgaaactttcgatcttcgt

SEQ ID NO: 10306 - DNA, 22 bp, Artificial Sequence
  Synthetic construct
atcgaaactttcgatcttcgtt

SEQ ID NO: 10307 - DNA, 22 bp, Artificial Sequence
  Synthetic construct
tcgaaactttcgatcttcgttt

SEQ ID NO: 10308 - DNA, 22 bp, Artificial Sequence
  Synthetic construct
cgaaactttcgatcttcgttta

SEQ ID NO: 10309 - DNA, 22 bp, Artificial Sequence
  Synthetic construct
gaaactttcgatcttcgtttag

SEQ ID NO: 10310 - DNA, 22 bp, Artificial Sequence
  Synthetic construct
aaactttcgatcttcgtttagg

SEQ ID NO: 10311 - DNA, 22 bp, Artificial Sequence
  Synthetic construct
aactttcgatcttcgtttaggg

SEQ ID NO: 10312 - DNA, 22 bp, Artificial Sequence
  Synthetic construct
actttcgatcttcgtttagggc

SEQ ID NO: 10313 - DNA, 22 bp, Artificial Sequence
  Synthetic construct
ctttcgatcttcgtttagggca

SEQ ID NO: 10314 - DNA, 22 bp, Artificial Sequence
  Synthetic construct
tttcgatcttcgtttagggcaa

SEQ ID NO: 10315 - DNA, 22 bp, Artificial Sequence
  Synthetic construct
ttcgatcttcgtttagggcaag

SEQ ID NO: 10316 - DNA, 22 bp, Artificial Sequence
  Synthetic construct
tcgatcttcgtttagggcaagg

SEQ ID NO: 10317 - DNA, 22 bp, Artificial Sequence
  Synthetic construct
cgatcttcgtttagggcaaggt

SEQ ID NO: 10318 - DNA, 22 bp, Artificial Sequence
  Synthetic construct
gatcttcgtttagggcaaggta

SEQ ID NO: 10319 - DNA, 22 bp, Artificial Sequence
  Synthetic construct
atcttcgtttagggcaaggtag

SEQ ID NO: 10320 - DNA, 22 bp, Artificial Sequence
  Synthetic construct
tcttcgtttagggcaaggtagc

SEQ ID NO: 10321 - DNA, 22 bp, Artificial Sequence
  Synthetic construct
cttcgtttagggcaaggtagcg

SEQ ID NO: 10322 - DNA, 22 bp, Artificial Sequence
  Synthetic construct
ttcgtttagggcaaggtagcgg

SEQ ID NO: 10323 - DNA, 22 bp, Artificial Sequence
  Synthetic construct
tcgtttagggcaaggtagcgga

SEQ ID NO: 10324 - DNA, 22 bp, Artificial Sequence
  Synthetic construct
cgtttagggcaaggtagcggag

SEQ ID NO: 10325 - DNA, 22 bp, Artificial Sequence
  Synthetic construct
gtttagggcaaggtagcggagc

SEQ ID NO: 10326 - DNA, 22 bp, Artificial Sequence
  Synthetic construct
tttagggcaaggtagcggagcg

SEQ ID NO: 10327 - DNA, 22 bp, Artificial Sequence
  Synthetic construct
ttagggcaaggtagcggagcgc

SEQ ID NO: 10328 - DNA, 22 bp, Artificial Sequence
  Synthetic construct
tagggcaaggtagcggagcgcc

SEQ ID NO: 10329 - DNA, 22 bp, Artificial Sequence
  Synthetic construct
agggcaaggtagcggagcgcct

SEQ ID NO: 10330 - DNA, 22 bp, Artificial Sequence
  Synthetic construct
gggcaaggtagcggagcgcctg

SEQ ID NO: 10331 - DNA, 22 bp, Artificial Sequence
  Synthetic construct
ggcaaggtagcggagcgcctgg

SEQ ID NO: 10332 - DNA, 22 bp, Artificial Sequence
  Synthetic construct
gcaaggtagcggagcgcctggc

SEQ ID NO: 10333 - DNA, 22 bp, Artificial Sequence
  Synthetic construct
caaggtagcggagcgcctggcg

SEQ ID NO: 10334 - DNA, 22 bp, Artificial Sequence
  Synthetic construct
aaggtagcggagcgcctggcgc

SEQ ID NO: 10335 - DNA, 22 bp, Artificial Sequence
  Synthetic construct
aggtagcggagcgcctggcgcc

SEQ ID NO: 10336 - DNA, 22 bp, Artificial Sequence
  Synthetic construct
ggtagcggagcgcctggcgcca

SEQ ID NO: 10337 - DNA, 22 bp, Artificial Sequence
  Synthetic construct
gtagcggagcgcctggcgccaa

SEQ ID NO: 10338 - DNA, 22 bp, Artificial Sequence
  Synthetic construct
tagcggagcgcctggcgccaat

SEQ ID NO: 10339 - DNA, 22 bp, Artificial Sequence
  Synthetic construct
agcggagcgcctggcgccaatt

SEQ ID NO: 10340 - DNA, 22 bp, Artificial Sequence
  Synthetic construct
gcggagcgcctggcgccaatta

SEQ ID NO: 10341 - DNA, 22 bp, Artificial Sequence
  Synthetic construct
cggagcgcctggcgccaattac

SEQ ID NO: 10342 - DNA, 22 bp, Artificial Sequence
  Synthetic construct
ggagcgcctggcgccaattacc

SEQ ID NO: 10343 - DNA, 22 bp, Artificial Sequence
  Synthetic construct
gagcgcctggcgccaattaccg

SEQ ID NO: 10344 - DNA, 22 bp, Artificial Sequence
  Synthetic construct
agcgcctggcgccaattaccgc

SEQ ID NO: 10345 - DNA, 22 bp, Artificial Sequence
  Synthetic construct
gcgcctggcgccaattaccgcg

SEQ ID NO: 10346 - DNA, 22 bp, Artificial Sequence
  Synthetic construct
cgcctggcgccaattaccgcga

SEQ ID NO: 10347 - DNA, 22 bp, Artificial Sequence
  Synthetic construct
gcctggcgccaattaccgcgac

SEQ ID NO: 10348 - DNA, 22 bp, Artificial Sequence
  Synthetic construct
cctggcgccaattaccgcgacg

SEQ ID NO: 10349 - DNA, 22 bp, Artificial Sequence
  Synthetic construct
ctggcgccaattaccgcgacga

SEQ ID NO: 10350 - DNA, 22 bp, Artificial Sequence
  Synthetic construct
tggcgccaattaccgcgacgag

SEQ ID NO: 10351 - DNA, 22 bp, Artificial Sequence
  Synthetic construct
ggcgccaattaccgcgacgagc

SEQ ID NO: 10352 - DNA, 22 bp, Artificial Sequence
  Synthetic construct
gcgccaattaccgcgacgagcg

SEQ ID NO: 10353 - DNA, 22 bp, Artificial Sequence
  Synthetic construct
cgccaattaccgcgacgagcgg

SEQ ID NO: 10354 - DNA, 22 bp, Artificial Sequence
  Synthetic construct
gccaattaccgcgacgagcggc

SEQ ID NO: 10355 - DNA, 22 bp, Artificial Sequence
  Synthetic construct
ccaattaccgcgacgagcggca

SEQ ID NO: 10356 - DNA, 22 bp, Artificial Sequence
  Synthetic construct
caattaccgcgacgagcggcag

SEQ ID NO: 10357 - DNA, 22 bp, Artificial Sequence
  Synthetic construct
aattaccgcgacgagcggcagt

SEQ ID NO: 10358 - DNA, 22 bp, Artificial Sequence
  Synthetic construct
attaccgcgacgagcggcagtg

SEQ ID NO: 10359 - DNA, 22 bp, Artificial Sequence
  Synthetic construct
ttaccgcgacgagcggcagtgt

SEQ ID NO: 10360 - DNA, 22 bp, Artificial Sequence
  Synthetic construct
taccgcgacgagcggcagtgta

SEQ ID NO: 10361 - DNA, 22 bp, Artificial Sequence
  Synthetic construct
accgcgacgagcggcagtgtac

SEQ ID NO: 10362 - DNA, 22 bp, Artificial Sequence
  Synthetic construct
ccgcgacgagcggcagtgtacg

SEQ ID NO: 10363 - DNA, 22 bp, Artificial Sequence
  Synthetic construct
cgcgacgagcggcagtgtacgc

SEQ ID NO: 10364 - DNA, 22 bp, Artificial Sequence
  Synthetic construct
gcgacgagcggcagtgtacgcc

SEQ ID NO: 10365 - DNA, 22 bp, Artificial Sequence
  Synthetic construct
cgacgagcggcagtgtacgcct

SEQ ID NO: 10366 - DNA, 22 bp, Artificial Sequence
  Synthetic construct
gacgagcggcagtgtacgcctt

SEQ ID NO: 10367 - DNA, 22 bp, Artificial Sequence
  Synthetic construct
acgagcggcagtgtacgccttc

SEQ ID NO: 10368 - DNA, 22 bp, Artificial Sequence
  Synthetic construct
cgagcggcagtgtacgccttca

SEQ ID NO: 10369 - DNA, 22 bp, Artificial Sequence
  Synthetic construct
gagcggcagtgtacgccttcac

SEQ ID NO: 10370 - DNA, 22 bp, Artificial Sequence
  Synthetic construct
agcggcagtgtacgccttcacg

SEQ ID NO: 10371 - DNA, 22 bp, Artificial Sequence
  Synthetic construct
gcggcagtgtacgccttcacga

SEQ ID NO: 10372 - DNA, 22 bp, Artificial Sequence
  Synthetic construct
cggcagtgtacgccttcacgag

SEQ ID NO: 10373 - DNA, 22 bp, Artificial Sequence
  Synthetic construct
ggcagtgtacgccttcacgagc

SEQ ID NO: 10374 - DNA, 22 bp, Artificial Sequence
  Synthetic construct
gcagtgtacgccttcacgagcg

SEQ ID NO: 10375 - DNA, 22 bp, Artificial Sequence
  Synthetic construct
cagtgtacgccttcacgagcgc

SEQ ID NO: 10376 - DNA, 22 bp, Artificial Sequence
  Synthetic construct
agtgtacgccttcacgagcgca

SEQ ID NO: 10377 - DNA, 22 bp, Artificial Sequence
  Synthetic construct
gtgtacgccttcacgagcgcaa

SEQ ID NO: 10378 - DNA, 22 bp, Artificial Sequence
  Synthetic construct
tgtacgccttcacgagcgcaat

SEQ ID NO: 10379 - DNA, 22 bp, Artificial Sequence
  Synthetic construct
gtacgccttcacgagcgcaatg

SEQ ID NO: 10380 - DNA, 22 bp, Artificial Sequence
  Synthetic construct
tacgccttcacgagcgcaatgg

SEQ ID NO: 10381 - DNA, 22 bp, Artificial Sequence
  Synthetic construct
acgccttcacgagcgcaatggt

SEQ ID NO: 10382 - DNA, 22 bp, Artificial Sequence
  Synthetic construct
cgccttcacgagcgcaatggtt

SEQ ID NO: 10383 - DNA, 22 bp, Artificial Sequence
  Synthetic construct
gccttcacgagcgcaatggttt

SEQ ID NO: 10384 - DNA, 22 bp, Artificial Sequence
  Synthetic construct
ccttcacgagcgcaatggtttg

SEQ ID NO: 10385 - DNA, 22 bp, Artificial Sequence
  Synthetic construct
cttcacgagcgcaatggtttgc

SEQ ID NO: 10386 - DNA, 22 bp, Artificial Sequence
  Synthetic construct
ttcacgagcgcaatggtttgcg

SEQ ID NO: 10387 - DNA, 22 bp, Artificial Sequence
  Synthetic construct
tcacgagcgcaatggtttgcgt

SEQ ID NO: 10388 - DNA, 22 bp, Artificial Sequence
  Synthetic construct
cacgagcgcaatggtttgcgtc

SEQ ID NO: 10389 - DNA, 22 bp, Artificial Sequence
  Synthetic construct
acgagcgcaatggtttgcgtcg

SEQ ID NO: 10390 - DNA, 22 bp, Artificial Sequence
  Synthetic construct
cgagcgcaatggtttgcgtcgc

SEQ ID NO: 10391 - DNA, 22 bp, Artificial Sequence
  Synthetic construct
gagcgcaatggtttgcgtcgcg

SEQ ID NO: 10392 - DNA, 22 bp, Artificial Sequence
  Synthetic construct
agcgcaatggtttgcgtcgcga

SEQ ID NO: 10393 - DNA, 22 bp, Artificial Sequence
  Synthetic construct
gcgcaatggtttgcgtcgcgag

SEQ ID NO: 10394 - DNA, 22 bp, Artificial Sequence
  Synthetic construct
cgcaatggtttgcgtcgcgagt

SEQ ID NO: 10395 - DNA, 22 bp, Artificial Sequence
  Synthetic construct
gcaatggtttgcgtcgcgagtt

SEQ ID NO: 10396 - DNA, 22 bp, Artificial Sequence
  Synthetic construct
caatggtttgcgtcgcgagttg

SEQ ID NO: 10397 - DNA, 22 bp, Artificial Sequence
  Synthetic construct
aatggtttgcgtcgcgagttgt

SEQ ID NO: 10398 - DNA, 22 bp, Artificial Sequence
  Synthetic construct
atggtttgcgtcgcgagttgtg

SEQ ID NO: 10399 - DNA, 22 bp, Artificial Sequence
  Synthetic construct
tggtttgcgtcgcgagttgtga

SEQ ID NO: 10400 - DNA, 22 bp, Artificial Sequence
  Synthetic construct
ggtttgcgtcgcgagttgtgag

SEQ ID NO: 10401 - DNA, 22 bp, Artificial Sequence
  Synthetic construct
gtttgcgtcgcgagttgtgagg

SEQ ID NO: 10402 - DNA, 22 bp, Artificial Sequence
  Synthetic construct
tttgcgtcgcgagttgtgaggc

SEQ ID NO: 10403 - DNA, 22 bp, Artificial Sequence
  Synthetic construct
ttgcgtcgcgagttgtgaggct

SEQ ID NO: 10404 - DNA, 22 bp, Artificial Sequence
  Synthetic construct
tgcgtcgcgagttgtgaggctg

SEQ ID NO: 10405 - DNA, 22 bp, Artificial Sequence
  Synthetic construct
gcgtcgcgagttgtgaggctgt

SEQ ID NO: 10406 - DNA, 22 bp, Artificial Sequence
  Synthetic construct
cgtcgcgagttgtgaggctgtc

SEQ ID NO: 10407 - DNA, 22 bp, Artificial Sequence
  Synthetic construct
gtcgcgagttgtgaggctgtcg

SEQ ID NO: 10408 - DNA, 22 bp, Artificial Sequence
  Synthetic construct
tcgcgagttgtgaggctgtcga

SEQ ID NO: 10409 - DNA, 22 bp, Artificial Sequence
  Synthetic construct
cgcgagttgtgaggctgtcgac

SEQ ID NO: 10410 - DNA, 22 bp, Artificial Sequence
  Synthetic construct
gcgagttgtgaggctgtcgacc

SEQ ID NO: 10411 - DNA, 22 bp, Artificial Sequence
  Synthetic construct
cgagttgtgaggctgtcgacct

SEQ ID NO: 10412 - DNA, 22 bp, Artificial Sequence
  Synthetic construct
gagttgtgaggctgtcgacctg

SEQ ID NO: 10413 - DNA, 22 bp, Artificial Sequence
  Synthetic construct
agttgtgaggctgtcgacctgg

SEQ ID NO: 10414 - DNA, 22 bp, Artificial Sequence
  Synthetic construct
gttgtgaggctgtcgacctggc

SEQ ID NO: 10415 - DNA, 22 bp, Artificial Sequence
  Synthetic construct
ttgtgaggctgtcgacctggcc

SEQ ID NO: 10416 - DNA, 22 bp, Artificial Sequence
  Synthetic construct
tgtgaggctgtcgacctggcct

SEQ ID NO: 10417 - DNA, 22 bp, Artificial Sequence
  Synthetic construct
gtgaggctgtcgacctggcctc

SEQ ID NO: 10418 - DNA, 22 bp, Artificial Sequence
  Synthetic construct
tgaggctgtcgacctggcctct

SEQ ID NO: 10419 - DNA, 22 bp, Artificial Sequence
  Synthetic construct
gaggctgtcgacctggcctctg

SEQ ID NO: 10420 - DNA, 22 bp, Artificial Sequence
  Synthetic construct
aggctgtcgacctggcctctgc

SEQ ID NO: 10421 - DNA, 22 bp, Artificial Sequence
  Synthetic construct
ggctgtcgacctggcctctgct

SEQ ID NO: 10422 - DNA, 22 bp, Artificial Sequence
  Synthetic construct
gctgtcgacctggcctctgcta

SEQ ID NO: 10423 - DNA, 22 bp, Artificial Sequence
  Synthetic construct
ctgtcgacctggcctctgctaa

SEQ ID NO: 10424 - DNA, 22 bp, Artificial Sequence
  Synthetic construct
tgtcgacctggcctctgctaaa

SEQ ID NO: 10425 - DNA, 22 bp, Artificial Sequence
  Synthetic construct
gtcgacctggcctctgctaaag

SEQ ID NO: 10426 - DNA, 22 bp, Artificial Sequence
  Synthetic construct
tcgacctggcctctgctaaagc

SEQ ID NO: 10427 - DNA, 22 bp, Artificial Sequence
  Synthetic construct
cgacctggcctctgctaaagca

SEQ ID NO: 10428 - DNA, 22 bp, Artificial Sequence
  Synthetic construct
gacctggcctctgctaaagcaa

SEQ ID NO: 10429 - DNA, 22 bp, Artificial Sequence
  Synthetic construct
acctggcctctgctaaagcaac

SEQ ID NO: 10430 - DNA, 22 bp, Artificial Sequence
  Synthetic construct
cctggcctctgctaaagcaaca

SEQ ID NO: 10431 - DNA, 22 bp, Artificial Sequence
  Synthetic construct
ctggcctctgctaaagcaacac

SEQ ID NO: 10432 - DNA, 22 bp, Artificial Sequence
  Synthetic construct
tggcctctgctaaagcaacacc

SEQ ID NO: 10433 - DNA, 22 bp, Artificial Sequence
  Synthetic construct
ggcctctgctaaagcaacacca

SEQ ID NO: 10434 - DNA, 22 bp, Artificial Sequence
  Synthetic construct
gcctctgctaaagcaacaccaa

SEQ ID NO: 10435 - DNA, 22 bp, Artificial Sequence
  Synthetic construct
cctctgctaaagcaacaccaag

SEQ ID NO: 10436 - DNA, 22 bp, Artificial Sequence
  Synthetic construct
ctctgctaaagcaacaccaagg

SEQ ID NO: 10437 - DNA, 22 bp, Artificial Sequence
  Synthetic construct
tctgctaaagcaacaccaaggt

SEQ ID NO: 10438 - DNA, 22 bp, Artificial Sequence
  Synthetic construct
ctgctaaagcaacaccaaggtt

SEQ ID NO: 10439 - DNA, 22 bp, Artificial Sequence
  Synthetic construct
tgctaaagcaacaccaaggtta

SEQ ID NO: 10440 - DNA, 22 bp, Artificial Sequence
  Synthetic construct
gctaaagcaacaccaaggttaa

SEQ ID NO: 10441 - DNA, 22 bp, Artificial Sequence
  Synthetic construct
ctaaagcaacaccaaggttaaa

SEQ ID NO: 10442 - DNA, 22 bp, Artificial Sequence
  Synthetic construct
taaagcaacaccaaggttaaaa

SEQ ID NO: 10443 - DNA, 22 bp, Artificial Sequence
  Synthetic construct
aaagcaacaccaaggttaaaat

SEQ ID NO: 10444 - DNA, 22 bp, Artificial Sequence
  Synthetic construct
aagcaacaccaaggttaaaatt

SEQ ID NO: 10445 - DNA, 22 bp, Artificial Sequence
  Synthetic construct
agcaacaccaaggttaaaatta

SEQ ID NO: 10446 - DNA, 22 bp, Artificial Sequence
  Synthetic construct
gcaacaccaaggttaaaattac

SEQ ID NO: 10447 - DNA, 22 bp, Artificial Sequence
  Synthetic construct
caacaccaaggttaaaattacc

SEQ ID NO: 10448 - DNA, 22 bp, Artificial Sequence
  Synthetic construct
aacaccaaggttaaaattaccc

SEQ ID NO: 10449 - DNA, 22 bp, Artificial Sequence
  Synthetic construct
acaccaaggttaaaattaccct

SEQ ID NO: 10450 - DNA, 22 bp, Artificial Sequence
  Synthetic construct
caccaaggttaaaattaccctg

SEQ ID NO: 10451 - DNA, 22 bp, Artificial Sequence
  Synthetic construct
accaaggttaaaattaccctgg

SEQ ID NO: 10452 - DNA, 22 bp, Artificial Sequence
  Synthetic construct
ccaaggttaaaattaccctggg

SEQ ID NO: 10453 - DNA, 22 bp, Artificial Sequence
  Synthetic construct
caaggttaaaattaccctgggt

SEQ ID NO: 10454 - DNA, 22 bp, Artificial Sequence
  Synthetic construct
aaggttaaaattaccctgggtg

SEQ ID NO: 10455 - DNA, 22 bp, Artificial Sequence
  Synthetic construct
aggttaaaattaccctgggtga

SEQ ID NO: 10456 - DNA, 22 bp, Artificial Sequence
  Synthetic construct
ggttaaaattaccctgggtgac

SEQ ID NO: 10457 - DNA, 22 bp, Artificial Sequence
  Synthetic construct
gttaaaattaccctgggtgacc

SEQ ID NO: 10458 - DNA, 22 bp, Artificial Sequence
  Synthetic construct
ttaaaattaccctgggtgacct

SEQ ID NO: 10459 - DNA, 22 bp, Artificial Sequence
  Synthetic construct
taaaattaccctgggtgacctt

SEQ ID NO: 10460 - DNA, 22 bp, Artificial Sequence
  Synthetic construct
aaaattaccctgggtgaccttt

SEQ ID NO: 10461 - DNA, 22 bp, Artificial Sequence
  Synthetic construct
aaattaccctgggtgacctttt

SEQ ID NO: 10462 - DNA, 22 bp, Artificial Sequence
  Synthetic construct
aattaccctgggtgaccttttg

SEQ ID NO: 10463 - DNA, 22 bp, Artificial Sequence
  Synthetic construct
attaccctgggtgaccttttgc

SEQ ID NO: 10464 - DNA, 22 bp, Artificial Sequence
  Synthetic construct
ttaccctgggtgaccttttgca

SEQ ID NO: 10465 - DNA, 22 bp, Artificial Sequence
  Synthetic construct
taccctgggtgaccttttgcag

SEQ ID NO: 10466 - DNA, 22 bp, Artificial Sequence
  Synthetic construct
accctgggtgaccttttgcagg

SEQ ID NO: 10467 - DNA, 22 bp, Artificial Sequence
  Synthetic construct
ccctgggtgaccttttgcagga

SEQ ID NO: 10468 - DNA, 22 bp, Artificial Sequence
  Synthetic construct
cctgggtgaccttttgcaggac

SEQ ID NO: 10469 - DNA, 22 bp, Artificial Sequence
  Synthetic construct
ctgggtgaccttttgcaggact

SEQ ID NO: 10470 - DNA, 22 bp, Artificial Sequence
  Synthetic construct
tgggtgaccttttgcaggactt

SEQ ID NO: 10471 - DNA, 22 bp, Artificial Sequence
  Synthetic construct
gggtgaccttttgcaggacttc

SEQ ID NO: 10472 - DNA, 22 bp, Artificial Sequence
  Synthetic construct
ggtgaccttttgcaggacttcg

SEQ ID NO: 10473 - DNA, 22 bp, Artificial Sequence
  Synthetic construct
gtgaccttttgcaggacttcgg

SEQ ID NO: 10474 - DNA, 22 bp, Artificial Sequence
  Synthetic construct
tgaccttttgcaggacttcggt

SEQ ID NO: 10475 - DNA, 22 bp, Artificial Sequence
  Synthetic construct
gaccttttgcaggacttcggtc

SEQ ID NO: 10476 - DNA, 22 bp, Artificial Sequence
  Synthetic construct
accttttgcaggacttcggtcg

SEQ ID NO: 10477 - DNA, 22 bp, Artificial Sequence
  Synthetic construct
ccttttgcaggacttcggtcga

SEQ ID NO: 10478 - DNA, 22 bp, Artificial Sequence
  Synthetic construct
cttttgcaggacttcggtcgac

SEQ ID NO: 10479 - DNA, 22 bp, Artificial Sequence
  Synthetic construct
ttttgcaggacttcggtcgacg

SEQ ID NO: 10480 - DNA, 22 bp, Artificial Sequence
  Synthetic construct
tttgcaggacttcggtcgacgc

SEQ ID NO: 10481 - DNA, 22 bp, Artificial Sequence
  Synthetic construct
ttgcaggacttcggtcgacgcc

SEQ ID NO: 10482 - DNA, 22 bp, Artificial Sequence
  Synthetic construct
tgcaggacttcggtcgacgccc

SEQ ID NO: 10483 - DNA, 22 bp, Artificial Sequence
  Synthetic construct
gcaggacttcggtcgacgcccg

SEQ ID NO: 10484 - DNA, 22 bp, Artificial Sequence
  Synthetic construct
caggacttcggtcgacgcccgg

SEQ ID NO: 10485 - DNA, 22 bp, Artificial Sequence
  Synthetic construct
aggacttcggtcgacgcccggt

SEQ ID NO: 10486 - DNA, 22 bp, Artificial Sequence
  Synthetic construct
ggacttcggtcgacgcccggtt

SEQ ID NO: 10487 - DNA, 22 bp, Artificial Sequence
  Synthetic construct
gacttcggtcgacgcccggttc

SEQ ID NO: 10488 - DNA, 22 bp, Artificial Sequence
  Synthetic construct
acttcggtcgacgcccggttcg

SEQ ID NO: 10489 - DNA, 22 bp, Artificial Sequence
  Synthetic construct
cttcggtcgacgcccggttcgc

SEQ ID NO: 10490 - DNA, 22 bp, Artificial Sequence
  Synthetic construct
ttcggtcgacgcccggttcgca

SEQ ID NO: 10491 - DNA, 22 bp, Artificial Sequence
  Synthetic construct
tcggtcgacgcccggttcgcaa

SEQ ID NO: 10492 - DNA, 22 bp, Artificial Sequence
  Synthetic construct
cggtcgacgcccggttcgcaac

SEQ ID NO: 10493 - DNA, 22 bp, Artificial Sequence
  Synthetic construct
ggtcgacgcccggttcgcaacg

SEQ ID NO: 10494 - DNA, 22 bp, Artificial Sequence
  Synthetic construct
gtcgacgcccggttcgcaacgt

SEQ ID NO: 10495 - DNA, 22 bp, Artificial Sequence
  Synthetic construct
tcgacgcccggttcgcaacgtt

SEQ ID NO: 10496 - DNA, 22 bp, Artificial Sequence
  Synthetic construct
cgacgcccggttcgcaacgttc

SEQ ID NO: 10497 - DNA, 22 bp, Artificial Sequence
  Synthetic construct
gacgcccggttcgcaacgttct

SEQ ID NO: 10498 - DNA, 22 bp, Artificial Sequence
  Synthetic construct
acgcccggttcgcaacgttctg

SEQ ID NO: 10499 - DNA, 22 bp, Artificial Sequence
  Synthetic construct
cgcccggttcgcaacgttctgc

SEQ ID NO: 10500 - DNA, 22 bp, Artificial Sequence
  Synthetic construct
gcccggttcgcaacgttctgcg

SEQ ID NO: 10501 - DNA, 22 bp, Artificial Sequence
  Synthetic construct
cccggttcgcaacgttctgcgg

SEQ ID NO: 10502 - DNA, 22 bp, Artificial Sequence
  Synthetic construct
ccggttcgcaacgttctgcggc

SEQ ID NO: 10503 - DNA, 22 bp, Artificial Sequence
  Synthetic construct
cggttcgcaacgttctgcggca

SEQ ID NO: 10504 - DNA, 22 bp, Artificial Sequence
  Synthetic construct
ggttcgcaacgttctgcggcac

SEQ ID NO: 10505 - DNA, 22 bp, Artificial Sequence
  Synthetic construct
gttcgcaacgttctgcggcact

SEQ ID NO: 10506 - DNA, 22 bp, Artificial Sequence
  Synthetic construct
ttcgcaacgttctgcggcactt

SEQ ID NO: 10507 - DNA, 22 bp, Artificial Sequence
  Synthetic construct
tcgcaacgttctgcggcacttc

SEQ ID NO: 10508 - DNA, 22 bp, Artificial Sequence
  Synthetic construct
cgcaacgttctgcggcacttcg

SEQ ID NO: 10509 - DNA, 22 bp, Artificial Sequence
  Synthetic construct
gcaacgttctgcggcacttcga

SEQ ID NO: 10510 - DNA, 22 bp, Artificial Sequence
  Synthetic construct
caacgttctgcggcacttcgat

SEQ ID NO: 10511 - DNA, 22 bp, Artificial Sequence
  Synthetic construct
aacgttctgcggcacttcgatg

SEQ ID NO: 10512 - DNA, 22 bp, Artificial Sequence
  Synthetic construct
acgttctgcggcacttcgatgt

SEQ ID NO: 10513 - DNA, 22 bp, Artificial Sequence
  Synthetic construct
cgttctgcggcacttcgatgta

SEQ ID NO: 10514 - DNA, 22 bp, Artificial Sequence
  Synthetic construct
gttctgcggcacttcgatgtaa

SEQ ID NO: 10515 - DNA, 22 bp, Artificial Sequence
  Synthetic construct
ttctgcggcacttcgatgtaag

SEQ ID NO: 10516 - DNA, 22 bp, Artificial Sequence
  Synthetic construct
tctgcggcacttcgatgtaagt

SEQ ID NO: 10517 - DNA, 22 bp, Artificial Sequence
  Synthetic construct
ctgcggcacttcgatgtaagtc

SEQ ID NO: 10518 - DNA, 22 bp, Artificial Sequence
  Synthetic construct
tgcggcacttcgatgtaagtca

SEQ ID NO: 10519 - DNA, 22 bp, Artificial Sequence
  Synthetic construct
gcggcacttcgatgtaagtcaa

SEQ ID NO: 10520 - DNA, 22 bp, Artificial Sequence
  Synthetic construct
cggcacttcgatgtaagtcaag

SEQ ID NO: 10521 - DNA, 22 bp, Artificial Sequence
  Synthetic construct
ggcacttcgatgtaagtcaagt

SEQ ID NO: 10522 - DNA, 22 bp, Artificial Sequence
  Synthetic construct
gcacttcgatgtaagtcaagtt

SEQ ID NO: 10523 - DNA, 22 bp, Artificial Sequence
  Synthetic construct
cacttcgatgtaagtcaagttt

SEQ ID NO: 10524 - DNA, 22 bp, Artificial Sequence
  Synthetic construct
acttcgatgtaagtcaagtttt

SEQ ID NO: 10525 - DNA, 22 bp, Artificial Sequence
  Synthetic construct
cttcgatgtaagtcaagttttg

SEQ ID NO: 10526 - DNA, 22 bp, Artificial Sequence
  Synthetic construct
ttcgatgtaagtcaagttttgg

SEQ ID NO: 10527 - DNA, 22 bp, Artificial Sequence
  Synthetic construct
tcgatgtaagtcaagttttggc

SEQ ID NO: 10528 - DNA, 22 bp, Artificial Sequence
  Synthetic construct
cgatgtaagtcaagttttggct

SEQ ID NO: 10529 - DNA, 22 bp, Artificial Sequence
  Synthetic construct
gatgtaagtcaagttttggctt

SEQ ID NO: 10530 - DNA, 22 bp, Artificial Sequence
  Synthetic construct
atgtaagtcaagttttggctta

SEQ ID NO: 10531 - DNA, 22 bp, Artificial Sequence
  Synthetic construct
tgtaagtcaagttttggcttac

SEQ ID NO: 10532 - DNA, 22 bp, Artificial Sequence
  Synthetic construct
gtaagtcaagttttggcttaca

SEQ ID NO: 10533 - DNA, 22 bp, Artificial Sequence
  Synthetic construct
taagtcaagttttggcttacag

SEQ ID NO: 10534 - DNA, 22 bp, Artificial Sequence
  Synthetic construct
aagtcaagttttggcttacagg

SEQ ID NO: 10535 - DNA, 22 bp, Artificial Sequence
  Synthetic construct
agtcaagttttggcttacaggg

SEQ ID NO: 10536 - DNA, 22 bp, Artificial Sequence
  Synthetic construct
gtcaagttttggcttacaggga

SEQ ID NO: 10537 - DNA, 22 bp, Artificial Sequence
  Synthetic construct
tcaagttttggcttacagggaa

SEQ ID NO: 10538 - DNA, 22 bp, Artificial Sequence
  Synthetic construct
caagttttggcttacagggaag

SEQ ID NO: 10539 - DNA, 22 bp, Artificial Sequence
  Synthetic construct
aagttttggcttacagggaaga

SEQ ID NO: 10540 - DNA, 22 bp, Artificial Sequence
  Synthetic construct
agttttggcttacagggaagag

SEQ ID NO: 10541 - DNA, 22 bp, Artificial Sequence
  Synthetic construct
gttttggcttacagggaagagg

SEQ ID NO: 10542 - DNA, 22 bp, Artificial Sequence
  Synthetic construct
ttttggcttacagggaagaggc

SEQ ID NO: 10543 - DNA, 22 bp, Artificial Sequence
  Synthetic construct
tttggcttacagggaagaggct

SEQ ID NO: 10544 - DNA, 22 bp, Artificial Sequence
  Synthetic construct
ttggcttacagggaagaggctg

SEQ ID NO: 10545 - DNA, 22 bp, Artificial Sequence
  Synthetic construct
tggcttacagggaagaggctgt

SEQ ID NO: 10546 - DNA, 22 bp, Artificial Sequence
  Synthetic construct
ggcttacagggaagaggctgta

SEQ ID NO: 10547 - DNA, 22 bp, Artificial Sequence
  Synthetic construct
gcttacagggaagaggctgtag

SEQ ID NO: 10548 - DNA, 22 bp, Artificial Sequence
  Synthetic construct
cttacagggaagaggctgtagc

SEQ ID NO: 10549 - DNA, 22 bp, Artificial Sequence
  Synthetic construct
ttacagggaagaggctgtagca

SEQ ID NO: 10550 - DNA, 22 bp, Artificial Sequence
  Synthetic construct
tacagggaagaggctgtagcag

SEQ ID NO: 10551 - DNA, 22 bp, Artificial Sequence
  Synthetic construct
acagggaagaggctgtagcagg

SEQ ID NO: 10552 - DNA, 22 bp, Artificial Sequence
  Synthetic construct
cagggaagaggctgtagcagga

SEQ ID NO: 10553 - DNA, 22 bp, Artificial Sequence
  Synthetic construct
agggaagaggctgtagcaggag

SEQ ID NO: 10554 - DNA, 22 bp, Artificial Sequence
  Synthetic construct
gggaagaggctgtagcaggagc

SEQ ID NO: 10555 - DNA, 22 bp, Artificial Sequence
  Synthetic construct
ggaagaggctgtagcaggagcg

SEQ ID NO: 10556 - DNA, 22 bp, Artificial Sequence
  Synthetic construct
gaagaggctgtagcaggagcgt

SEQ ID NO: 10557 - DNA, 22 bp, Artificial Sequence
  Synthetic construct
aagaggctgtagcaggagcgtg

SEQ ID NO: 10558 - DNA, 22 bp, Artificial Sequence
  Synthetic construct
agaggctgtagcaggagcgtgc

SEQ ID NO: 10559 - DNA, 22 bp, Artificial Sequence
  Synthetic construct
gaggctgtagcaggagcgtgcg

SEQ ID NO: 10560 - DNA, 22 bp, Artificial Sequence
  Synthetic construct
aggctgtagcaggagcgtgcgt

SEQ ID NO: 10561 - DNA, 22 bp, Artificial Sequence
  Synthetic construct
ggctgtagcaggagcgtgcgtc

SEQ ID NO: 10562 - DNA, 22 bp, Artificial Sequence
  Synthetic construct
gctgtagcaggagcgtgcgtcg

SEQ ID NO: 10563 - DNA, 22 bp, Artificial Sequence
  Synthetic construct
ctgtagcaggagcgtgcgtcga

SEQ ID NO: 10564 - DNA, 22 bp, Artificial Sequence
  Synthetic construct
tgtagcaggagcgtgcgtcgag

SEQ ID NO: 10565 - DNA, 22 bp, Artificial Sequence
  Synthetic construct
gtagcaggagcgtgcgtcgagg

SEQ ID NO: 10566 - DNA, 22 bp, Artificial Sequence
  Synthetic construct
tagcaggagcgtgcgtcgaggg

SEQ ID NO: 10567 - DNA, 22 bp, Artificial Sequence
  Synthetic construct
agcaggagcgtgcgtcgaggga

SEQ ID NO: 10568 - DNA, 22 bp, Artificial Sequence
  Synthetic construct
gcaggagcgtgcgtcgagggag

SEQ ID NO: 10569 - DNA, 22 bp, Artificial Sequence
  Synthetic construct
caggagcgtgcgtcgagggaga

SEQ ID NO: 10570 - DNA, 22 bp, Artificial Sequence
  Synthetic construct
aggagcgtgcgtcgagggagaa

SEQ ID NO: 10571 - DNA, 22 bp, Artificial Sequence
  Synthetic construct
ggagcgtgcgtcgagggagaag

SEQ ID NO: 10572 - DNA, 22 bp, Artificial Sequence
  Synthetic construct
gagcgtgcgtcgagggagaagc

SEQ ID NO: 10573 - DNA, 22 bp, Artificial Sequence
  Synthetic construct
agcgtgcgtcgagggagaagcc

SEQ ID NO: 10574 - DNA, 22 bp, Artificial Sequence
  Synthetic construct
gcgtgcgtcgagggagaagccg

SEQ ID NO: 10575 - DNA, 22 bp, Artificial Sequence
  Synthetic construct
cgtgcgtcgagggagaagccga

SEQ ID NO: 10576 - DNA, 22 bp, Artificial Sequence
  Synthetic construct
gtgcgtcgagggagaagccgaa

SEQ ID NO: 10577 - DNA, 22 bp, Artificial Sequence
  Synthetic construct
tgcgtcgagggagaagccgaaa

SEQ ID NO: 10578 - DNA, 22 bp, Artificial Sequence
  Synthetic construct
gcgtcgagggagaagccgaaac

SEQ ID NO: 10579 - DNA, 22 bp, Artificial Sequence
  Synthetic construct
cgtcgagggagaagccgaaacc

SEQ ID NO: 10580 - DNA, 22 bp, Artificial Sequence
  Synthetic construct
gtcgagggagaagccgaaaccg

SEQ ID NO: 10581 - DNA, 22 bp, Artificial Sequence
  Synthetic construct
tcgagggagaagccgaaaccgg

SEQ ID NO: 10582 - DNA, 22 bp, Artificial Sequence
  Synthetic construct
cgagggagaagccgaaaccggc

SEQ ID NO: 10583 - DNA, 22 bp, Artificial Sequence
  Synthetic construct
gagggagaagccgaaaccggct

SEQ ID NO: 10584 - DNA, 22 bp, Artificial Sequence
  Synthetic construct
agggagaagccgaaaccggctt

SEQ ID NO: 10585 - DNA, 22 bp, Artificial Sequence
  Synthetic construct
gggagaagccgaaaccggcttt

SEQ ID NO: 10586 - DNA, 22 bp, Artificial Sequence
  Synthetic construct
ggagaagccgaaaccggctttc

SEQ ID NO: 10587 - DNA, 22 bp, Artificial Sequence
  Synthetic construct
gagaagccgaaaccggctttct

SEQ ID NO: 10588 - DNA, 22 bp, Artificial Sequence
  Synthetic construct
agaagccgaaaccggctttctc

SEQ ID NO: 10589 - DNA, 22 bp, Artificial Sequence
  Synthetic construct
gaagccgaaaccggctttctcc

SEQ ID NO: 10590 - DNA, 22 bp, Artificial Sequence
  Synthetic construct
aagccgaaaccggctttctcct

SEQ ID NO: 10591 - DNA, 22 bp, Artificial Sequence
  Synthetic construct
agccgaaaccggctttctcctc

SEQ ID NO: 10592 - DNA, 22 bp, Artificial Sequence
  Synthetic construct
gccgaaaccggctttctcctcg

SEQ ID NO: 10593 - DNA, 22 bp, Artificial Sequence
  Synthetic construct
ccgaaaccggctttctcctcgt

SEQ ID NO: 10594 - DNA, 22 bp, Artificial Sequence
  Synthetic construct
cgaaaccggctttctcctcgta

SEQ ID NO: 10595 - DNA, 22 bp, Artificial Sequence
  Synthetic construct
gaaaccggctttctcctcgtac

SEQ ID NO: 10596 - DNA, 22 bp, Artificial Sequence
  Synthetic construct
aaaccggctttctcctcgtacg

SEQ ID NO: 10597 - DNA, 22 bp, Artificial Sequence
  Synthetic construct
aaccggctttctcctcgtacgg

SEQ ID NO: 10598 - DNA, 22 bp, Artificial Sequence
  Synthetic construct
accggctttctcctcgtacggg

SEQ ID NO: 10599 - DNA, 22 bp, Artificial Sequence
  Synthetic construct
ccggctttctcctcgtacgggc

SEQ ID NO: 10600 - DNA, 22 bp, Artificial Sequence
  Synthetic construct
cggctttctcctcgtacgggcg

SEQ ID NO: 10601 - DNA, 22 bp, Artificial Sequence
  Synthetic construct
ggctttctcctcgtacgggcga

SEQ ID NO: 10602 - DNA, 22 bp, Artificial Sequence
  Synthetic construct
gctttctcctcgtacgggcgac

SEQ ID NO: 10603 - DNA, 22 bp, Artificial Sequence
  Synthetic construct
ctttctcctcgtacgggcgacc

SEQ ID NO: 10604 - DNA, 22 bp, Artificial Sequence
  Synthetic construct
tttctcctcgtacgggcgaccc

SEQ ID NO: 10605 - DNA, 22 bp, Artificial Sequence
  Synthetic construct
ttctcctcgtacgggcgacccc

SEQ ID NO: 10606 - DNA, 22 bp, Artificial Sequence
  Synthetic construct
tctcctcgtacgggcgacccca

SEQ ID NO: 10607 - DNA, 22 bp, Artificial Sequence
  Synthetic construct
ctcctcgtacgggcgaccccac

SEQ ID NO: 10608 - DNA, 22 bp, Artificial Sequence
  Synthetic construct
tcctcgtacgggcgaccccacg

SEQ ID NO: 10609 - DNA, 22 bp, Artificial Sequence
  Synthetic construct
cctcgtacgggcgaccccacga

SEQ ID NO: 10610 - DNA, 22 bp, Artificial Sequence
  Synthetic construct
ctcgtacgggcgaccccacgat

SEQ ID NO: 10611 - DNA, 22 bp, Artificial Sequence
  Synthetic construct
tcgtacgggcgaccccacgatg

SEQ ID NO: 10612 - DNA, 22 bp, Artificial Sequence
  Synthetic construct
cgtacgggcgaccccacgatga

SEQ ID NO: 10613 - DNA, 22 bp, Artificial Sequence
  Synthetic construct
gtacgggcgaccccacgatgac

SEQ ID NO: 10614 - DNA, 22 bp, Artificial Sequence
  Synthetic construct
tacgggcgaccccacgatgacc

SEQ ID NO: 10615 - DNA, 22 bp, Artificial Sequence
  Synthetic construct
acgggcgaccccacgatgaccc

SEQ ID NO: 10616 - DNA, 22 bp, Artificial Sequence
  Synthetic construct
cgggcgaccccacgatgaccca

SEQ ID NO: 10617 - DNA, 22 bp, Artificial Sequence
  Synthetic construct
gggcgaccccacgatgacccac

SEQ ID NO: 10618 - DNA, 22 bp, Artificial Sequence
  Synthetic construct
ggcgaccccacgatgacccact

SEQ ID NO: 10619 - DNA, 22 bp, Artificial Sequence
  Synthetic construct
gcgaccccacgatgacccactt

SEQ ID NO: 10620 - DNA, 22 bp, Artificial Sequence
  Synthetic construct
cgaccccacgatgacccacttc

SEQ ID NO: 10621 - DNA, 22 bp, Artificial Sequence
  Synthetic construct
gaccccacgatgacccacttcg

SEQ ID NO: 10622 - DNA, 22 bp, Artificial Sequence
  Synthetic construct
accccacgatgacccacttcgc

SEQ ID NO: 10623 - DNA, 22 bp, Artificial Sequence
  Synthetic construct
ccccacgatgacccacttcgct

SEQ ID NO: 10624 - DNA, 22 bp, Artificial Sequence
  Synthetic construct
cccacgatgacccacttcgctt

SEQ ID NO: 10625 - DNA, 22 bp, Artificial Sequence
  Synthetic construct
ccacgatgacccacttcgcttg

SEQ ID NO: 10626 - DNA, 22 bp, Artificial Sequence
  Synthetic construct
cacgatgacccacttcgcttgt

SEQ ID NO: 10627 - DNA, 22 bp, Artificial Sequence
  Synthetic construct
acgatgacccacttcgcttgta

SEQ ID NO: 10628 - DNA, 22 bp, Artificial Sequence
  Synthetic construct
cgatgacccacttcgcttgtag

SEQ ID NO: 10629 - DNA, 22 bp, Artificial Sequence
  Synthetic construct
gatgacccacttcgcttgtagg

SEQ ID NO: 10630 - DNA, 22 bp, Artificial Sequence
  Synthetic construct
atgacccacttcgcttgtaggc

SEQ ID NO: 10631 - DNA, 22 bp, Artificial Sequence
  Synthetic construct
tgacccacttcgcttgtaggca

SEQ ID NO: 10632 - DNA, 22 bp, Artificial Sequence
  Synthetic construct
gacccacttcgcttgtaggcac

SEQ ID NO: 10633 - DNA, 22 bp, Artificial Sequence
  Synthetic construct
acccacttcgcttgtaggcacc

SEQ ID NO: 10634 - DNA, 22 bp, Artificial Sequence
  Synthetic construct
cccacttcgcttgtaggcacct

SEQ ID NO: 10635 - DNA, 22 bp, Artificial Sequence
  Synthetic construct
ccacttcgcttgtaggcacctt

SEQ ID NO: 10636 - DNA, 22 bp, Artificial Sequence
  Synthetic construct
cacttcgcttgtaggcaccttg

SEQ ID NO: 10637 - DNA, 22 bp, Artificial Sequence
  Synthetic construct
acttcgcttgtaggcaccttga

SEQ ID NO: 10638 - DNA, 22 bp, Artificial Sequence
  Synthetic construct
cttcgcttgtaggcaccttgat

SEQ ID NO: 10639 - DNA, 22 bp, Artificial Sequence
  Synthetic construct
ttcgcttgtaggcaccttgatc

SEQ ID NO: 10640 - DNA, 22 bp, Artificial Sequence
  Synthetic construct
tcgcttgtaggcaccttgatct

SEQ ID NO: 10641 - DNA, 22 bp, Artificial Sequence
  Synthetic construct
cgcttgtaggcaccttgatcta

SEQ ID NO: 10642 - DNA, 22 bp, Artificial Sequence
  Synthetic construct
gcttgtaggcaccttgatctat

SEQ ID NO: 10643 - DNA, 22 bp, Artificial Sequence
  Synthetic construct
cttgtaggcaccttgatctatc

SEQ ID NO: 10644 - DNA, 22 bp, Artificial Sequence
  Synthetic construct
ttgtaggcaccttgatctatcg

SEQ ID NO: 10645 - DNA, 22 bp, Artificial Sequence
  Synthetic construct
tgtaggcaccttgatctatcga

SEQ ID NO: 10646 - DNA, 22 bp, Artificial Sequence
  Synthetic construct
gtaggcaccttgatctatcgat

SEQ ID NO: 10647 - DNA, 22 bp, Artificial Sequence
  Synthetic construct
taggcaccttgatctatcgatg

SEQ ID NO: 10648 - DNA, 22 bp, Artificial Sequence
  Synthetic construct
aggcaccttgatctatcgatgt

SEQ ID NO: 10649 - DNA, 22 bp, Artificial Sequence
  Synthetic construct
ggcaccttgatctatcgatgtg

SEQ ID NO: 10650 - DNA, 22 bp, Artificial Sequence
  Synthetic construct
gcaccttgatctatcgatgtga

SEQ ID NO: 10651 - DNA, 22 bp, Artificial Sequence
  Synthetic construct
caccttgatctatcgatgtgac

SEQ ID NO: 10652 - DNA, 22 bp, Artificial Sequence
  Synthetic construct
accttgatctatcgatgtgaca

SEQ ID NO: 10653 - DNA, 22 bp, Artificial Sequence
  Synthetic construct
ccttgatctatcgatgtgacac

SEQ ID NO: 10654 - DNA, 22 bp, Artificial Sequence
  Synthetic construct
cttgatctatcgatgtgacact

SEQ ID NO: 10655 - DNA, 22 bp, Artificial Sequence
  Synthetic construct
ttgatctatcgatgtgacactt

SEQ ID NO: 10656 - DNA, 22 bp, Artificial Sequence
  Synthetic construct
tgatctatcgatgtgacactta

SEQ ID NO: 10657 - DNA, 22 bp, Artificial Sequence
  Synthetic construct
gatctatcgatgtgacacttaa

SEQ ID NO: 10658 - DNA, 22 bp, Artificial Sequence
  Synthetic construct
atctatcgatgtgacacttaac

SEQ ID NO: 10659 - DNA, 22 bp, Artificial Sequence
  Synthetic construct
tctatcgatgtgacacttaacg

SEQ ID NO: 10660 - DNA, 22 bp, Artificial Sequence
  Synthetic construct
ctatcgatgtgacacttaacgc

SEQ ID NO: 10661 - DNA, 22 bp, Artificial Sequence
  Synthetic construct
tatcgatgtgacacttaacgcc

SEQ ID NO: 10662 - DNA, 22 bp, Artificial Sequence
  Synthetic construct
atcgatgtgacacttaacgccc

SEQ ID NO: 10663 - DNA, 22 bp, Artificial Sequence
  Synthetic construct
tcgatgtgacacttaacgcccc

SEQ ID NO: 10664 - DNA, 22 bp, Artificial Sequence
  Synthetic construct
cgatgtgacacttaacgccccc

SEQ ID NO: 10665 - DNA, 22 bp, Artificial Sequence
  Synthetic construct
gatgtgacacttaacgcccccc

SEQ ID NO: 10666 - DNA, 22 bp, Artificial Sequence
  Synthetic construct
atgtgacacttaacgccccccg

SEQ ID NO: 10667 - DNA, 22 bp, Artificial Sequence
  Synthetic construct
tgtgacacttaacgccccccgt

SEQ ID NO: 10668 - DNA, 22 bp, Artificial Sequence
  Synthetic construct
gtgacacttaacgccccccgtg

SEQ ID NO: 10669 - DNA, 22 bp, Artificial Sequence
  Synthetic construct
tgacacttaacgccccccgtga

SEQ ID NO: 10670 - DNA, 22 bp, Artificial Sequence
  Synthetic construct
gacacttaacgccccccgtgaa

SEQ ID NO: 10671 - DNA, 22 bp, Artificial Sequence
  Synthetic construct
acacttaacgccccccgtgaat

SEQ ID NO: 10672 - DNA, 22 bp, Artificial Sequence
  Synthetic construct
cacttaacgccccccgtgaata

SEQ ID NO: 10673 - DNA, 22 bp, Artificial Sequence
  Synthetic construct
acttaacgccccccgtgaatac

SEQ ID NO: 10674 - DNA, 22 bp, Artificial Sequence
  Synthetic construct
cttaacgccccccgtgaatacg

SEQ ID NO: 10675 - DNA, 22 bp, Artificial Sequence
  Synthetic construct
ttaacgccccccgtgaatacgg

SEQ ID NO: 10676 - DNA, 22 bp, Artificial Sequence
  Synthetic construct
taacgccccccgtgaatacgga

SEQ ID NO: 10677 - DNA, 22 bp, Artificial Sequence
  Synthetic construct
aacgccccccgtgaatacggag

SEQ ID NO: 10678 - DNA, 22 bp, Artificial Sequence
  Synthetic construct
acgccccccgtgaatacggaga

SEQ ID NO: 10679 - DNA, 22 bp, Artificial Sequence
  Synthetic construct
cgccccccgtgaatacggagag

SEQ ID NO: 10680 - DNA, 22 bp, Artificial Sequence
  Synthetic construct
gccccccgtgaatacggagagg

SEQ ID NO: 10681 - DNA, 22 bp, Artificial Sequence
  Synthetic construct
ccccccgtgaatacggagaggg

SEQ ID NO: 10682 - DNA, 22 bp, Artificial Sequence
  Synthetic construct
cccccgtgaatacggagagggg

SEQ ID NO: 10683 - DNA, 22 bp, Artificial Sequence
  Synthetic construct
ccccgtgaatacggagaggggt

SEQ ID NO: 10684 - DNA, 22 bp, Artificial Sequence
  Synthetic construct
cccgtgaatacggagaggggta

SEQ ID NO: 10685 - DNA, 22 bp, Artificial Sequence
  Synthetic construct
ccgtgaatacggagaggggtag

SEQ ID NO: 10686 - DNA, 22 bp, Artificial Sequence
  Synthetic construct
cgtgaatacggagaggggtagt

SEQ ID NO: 10687 - DNA, 22 bp, Artificial Sequence
  Synthetic construct
gtgaatacggagaggggtagtg

SEQ ID NO: 10688 - DNA, 22 bp, Artificial Sequence
  Synthetic construct
tgaatacggagaggggtagtgc

SEQ ID NO: 10689 - DNA, 22 bp, Artificial Sequence
  Synthetic construct
gaatacggagaggggtagtgcc

SEQ ID NO: 10690 - DNA, 22 bp, Artificial Sequence
  Synthetic construct
aatacggagaggggtagtgcca

SEQ ID NO: 10691 - DNA, 22 bp, Artificial Sequence
  Synthetic construct
atacggagaggggtagtgccac

SEQ ID NO: 10692 - DNA, 22 bp, Artificial Sequence
  Synthetic construct
tacggagaggggtagtgccact

SEQ ID NO: 10693 - DNA, 22 bp, Artificial Sequence
  Synthetic construct
acggagaggggtagtgccactg

SEQ ID NO: 10694 - DNA, 22 bp, Artificial Sequence
  Synthetic construct
cggagaggggtagtgccactgt

SEQ ID NO: 10695 - DNA, 22 bp, Artificial Sequence
  Synthetic construct
ggagaggggtagtgccactgtt

SEQ ID NO: 10696 - DNA, 22 bp, Artificial Sequence
  Synthetic construct
gagaggggtagtgccactgttt

SEQ ID NO: 10697 - DNA, 22 bp, Artificial Sequence
  Synthetic construct
agaggggtagtgccactgtttc

SEQ ID NO: 10698 - DNA, 22 bp, Artificial Sequence
  Synthetic construct
gaggggtagtgccactgtttcg

SEQ ID NO: 10699 - DNA, 22 bp, Artificial Sequence
  Synthetic construct
aggggtagtgccactgtttcgt

SEQ ID NO: 10700 - DNA, 22 bp, Artificial Sequence
  Synthetic construct
ggggtagtgccactgtttcgtt

SEQ ID NO: 10701 - DNA, 22 bp, Artificial Sequence
  Synthetic construct
gggtagtgccactgtttcgttt

SEQ ID NO: 10702 - DNA, 22 bp, Artificial Sequence
  Synthetic construct
ggtagtgccactgtttcgtttt

SEQ ID NO: 10703 - DNA, 22 bp, Artificial Sequence
  Synthetic construct
gtagtgccactgtttcgttttg

SEQ ID NO: 10704 - DNA, 22 bp, Artificial Sequence
  Synthetic construct
tagtgccactgtttcgttttgg

SEQ ID NO: 10705 - DNA, 22 bp, Artificial Sequence
  Synthetic construct
agtgccactgtttcgttttggc

SEQ ID NO: 10706 - DNA, 22 bp, Artificial Sequence
  Synthetic construct
gtgccactgtttcgttttggcc

SEQ ID NO: 10707 - DNA, 22 bp, Artificial Sequence
  Synthetic construct
tgccactgtttcgttttggccc

SEQ ID NO: 10708 - DNA, 22 bp, Artificial Sequence
  Synthetic construct
gccactgtttcgttttggcccc

SEQ ID NO: 10709 - DNA, 22 bp, Artificial Sequence
  Synthetic construct
ccactgtttcgttttggcccca

SEQ ID NO: 10710 - DNA, 22 bp, Artificial Sequence
  Synthetic construct
cactgtttcgttttggccccag

SEQ ID NO: 10711 - DNA, 22 bp, Artificial Sequence
  Synthetic construct
actgtttcgttttggccccagt

SEQ ID NO: 10712 - DNA, 22 bp, Artificial Sequence
  Synthetic construct
ctgtttcgttttggccccagtc

SEQ ID NO: 10713 - DNA, 22 bp, Artificial Sequence
  Synthetic construct
tgtttcgttttggccccagtcg

SEQ ID NO: 10714 - DNA, 22 bp, Artificial Sequence
  Synthetic construct
gtttcgttttggccccagtcga

SEQ ID NO: 10715 - DNA, 22 bp, Artificial Sequence
  Synthetic construct
tttcgttttggccccagtcgag

SEQ ID NO: 10716 - DNA, 22 bp, Artificial Sequence
  Synthetic construct
ttcgttttggccccagtcgagt

SEQ ID NO: 10717 - DNA, 22 bp, Artificial Sequence
  Synthetic construct
tcgttttggccccagtcgagtt

SEQ ID NO: 10718 - DNA, 22 bp, Artificial Sequence
  Synthetic construct
cgttttggccccagtcgagtta

SEQ ID NO: 10719 - DNA, 22 bp, Artificial Sequence
  Synthetic construct
gttttggccccagtcgagttaa

SEQ ID NO: 10720 - DNA, 22 bp, Artificial Sequence
  Synthetic construct
ttttggccccagtcgagttaaa

SEQ ID NO: 10721 - DNA, 22 bp, Artificial Sequence
  Synthetic construct
tttggccccagtcgagttaaaa

SEQ ID NO: 10722 - DNA, 22 bp, Artificial Sequence
  Synthetic construct
ttggccccagtcgagttaaaac

SEQ ID NO: 10723 - DNA, 22 bp, Artificial Sequence
  Synthetic construct
tggccccagtcgagttaaaacg

SEQ ID NO: 10724 - DNA, 22 bp, Artificial Sequence
  Synthetic construct
ggccccagtcgagttaaaacga

SEQ ID NO: 10725 - DNA, 22 bp, Artificial Sequence
  Synthetic construct
gccccagtcgagttaaaacgac

SEQ ID NO: 10726 - DNA, 22 bp, Artificial Sequence
  Synthetic construct
ccccagtcgagttaaaacgacc

SEQ ID NO: 10727 - DNA, 22 bp, Artificial Sequence
  Synthetic construct
cccagtcgagttaaaacgaccg

SEQ ID NO: 10728 - DNA, 22 bp, Artificial Sequence
  Synthetic construct
ccagtcgagttaaaacgaccgg

SEQ ID NO: 10729 - DNA, 22 bp, Artificial Sequence
  Synthetic construct
cagtcgagttaaaacgaccggg

SEQ ID NO: 10730 - DNA, 22 bp, Artificial Sequence
  Synthetic construct
agtcgagttaaaacgaccggga

SEQ ID NO: 10731 - DNA, 22 bp, Artificial Sequence
  Synthetic construct
gtcgagttaaaacgaccgggag

SEQ ID NO: 10732 - DNA, 22 bp, Artificial Sequence
  Synthetic construct
tcgagttaaaacgaccgggagt

SEQ ID NO: 10733 - DNA, 22 bp, Artificial Sequence
  Synthetic construct
cgagttaaaacgaccgggagtc

SEQ ID NO: 10734 - DNA, 22 bp, Artificial Sequence
  Synthetic construct
gagttaaaacgaccgggagtcc

SEQ ID NO: 10735 - DNA, 22 bp, Artificial Sequence
  Synthetic construct
agttaaaacgaccgggagtcca

SEQ ID NO: 10736 - DNA, 22 bp, Artificial Sequence
  Synthetic construct
gttaaaacgaccgggagtccag

SEQ ID NO: 10737 - DNA, 22 bp, Artificial Sequence
  Synthetic construct
ttaaaacgaccgggagtccagt

SEQ ID NO: 10738 - DNA, 22 bp, Artificial Sequence
  Synthetic construct
taaaacgaccgggagtccagtt

SEQ ID NO: 10739 - DNA, 22 bp, Artificial Sequence
  Synthetic construct
aaaacgaccgggagtccagttc

SEQ ID NO: 10740 - DNA, 22 bp, Artificial Sequence
  Synthetic construct
aaacgaccgggagtccagttcg

SEQ ID NO: 10741 - DNA, 22 bp, Artificial Sequence
  Synthetic construct
aacgaccgggagtccagttcga

SEQ ID NO: 10742 - DNA, 22 bp, Artificial Sequence
  Synthetic construct
acgaccgggagtccagttcgaa

SEQ ID NO: 10743 - DNA, 22 bp, Artificial Sequence
  Synthetic construct
cgaccgggagtccagttcgaac

SEQ ID NO: 10744 - DNA, 22 bp, Artificial Sequence
  Synthetic construct
gaccgggagtccagttcgaacg

SEQ ID NO: 10745 - DNA, 22 bp, Artificial Sequence
  Synthetic construct
accgggagtccagttcgaacga

SEQ ID NO: 10746 - DNA, 22 bp, Artificial Sequence
  Synthetic construct
ccgggagtccagttcgaacgat

SEQ ID NO: 10747 - DNA, 22 bp, Artificial Sequence
  Synthetic construct
cgggagtccagttcgaacgata

SEQ ID NO: 10748 - DNA, 22 bp, Artificial Sequence
  Synthetic construct
gggagtccagttcgaacgatat

SEQ ID NO: 10749 - DNA, 22 bp, Artificial Sequence
  Synthetic construct
ggagtccagttcgaacgatatt

SEQ ID NO: 10750 - DNA, 22 bp, Artificial Sequence
  Synthetic construct
gagtccagttcgaacgatattt

SEQ ID NO: 10751 - DNA, 22 bp, Artificial Sequence
  Synthetic construct
agtccagttcgaacgatatttt

SEQ ID NO: 10752 - DNA, 22 bp, Artificial Sequence
  Synthetic construct
gtccagttcgaacgatatttta

SEQ ID NO: 10753 - DNA, 22 bp, Artificial Sequence
  Synthetic construct
tccagttcgaacgatattttaa

SEQ ID NO: 10754 - DNA, 22 bp, Artificial Sequence
  Synthetic construct
ccagttcgaacgatattttaaa

SEQ ID NO: 10755 - DNA, 22 bp, Artificial Sequence
  Synthetic construct
cagttcgaacgatattttaaag

SEQ ID NO: 10756 - DNA, 22 bp, Artificial Sequence
  Synthetic construct
agttcgaacgatattttaaaga

SEQ ID NO: 10757 - DNA, 22 bp, Artificial Sequence
  Synthetic construct
gttcgaacgatattttaaagag

SEQ ID NO: 10758 - DNA, 22 bp, Artificial Sequence
  Synthetic construct
ttcgaacgatattttaaagaga

SEQ ID NO: 10759 - DNA, 22 bp, Artificial Sequence
  Synthetic construct
tcgaacgatattttaaagagaa

SEQ ID NO: 10760 - DNA, 22 bp, Artificial Sequence
  Synthetic construct
cgaacgatattttaaagagaat

SEQ ID NO: 10761 - DNA, 22 bp, Artificial Sequence
  Synthetic construct
gaacgatattttaaagagaatg

SEQ ID NO: 10762 - DNA, 22 bp, Artificial Sequence
  Synthetic construct
aacgatattttaaagagaatga

SEQ ID NO: 10763 - DNA, 22 bp, Artificial Sequence
  Synthetic construct
acgatattttaaagagaatgag

SEQ ID NO: 10764 - DNA, 22 bp, Artificial Sequence
  Synthetic construct
cgatattttaaagagaatgagt

SEQ ID NO: 10765 - DNA, 22 bp, Artificial Sequence
  Synthetic construct
gatattttaaagagaatgagtt

SEQ ID NO: 10766 - DNA, 22 bp, Artificial Sequence
  Synthetic construct
atattttaaagagaatgagtta

SEQ ID NO: 10767 - DNA, 22 bp, Artificial Sequence
  Synthetic construct
tattttaaagagaatgagttat

SEQ ID NO: 10768 - DNA, 22 bp, Artificial Sequence
  Synthetic construct
attttaaagagaatgagttatc

SEQ ID NO: 10769 - DNA, 22 bp, Artificial Sequence
  Synthetic construct
ttttaaagagaatgagttatct

SEQ ID NO: 10770 - DNA, 22 bp, Artificial Sequence
  Synthetic construct
tttaaagagaatgagttatctt

SEQ ID NO: 10771 - DNA, 22 bp, Artificial Sequence
  Synthetic construct
ttaaagagaatgagttatcttc

SEQ ID NO: 10772 - DNA, 22 bp, Artificial Sequence
  Synthetic construct
taaagagaatgagttatcttca

SEQ ID NO: 10773 - DNA, 22 bp, Artificial Sequence
  Synthetic construct
aaagagaatgagttatcttcag

SEQ ID NO: 10774 - DNA, 22 bp, Artificial Sequence
  Synthetic construct
aagagaatgagttatcttcagt

SEQ ID NO: 10775 - DNA, 22 bp, Artificial Sequence
  Synthetic construct
agagaatgagttatcttcagtc

SEQ ID NO: 10776 - DNA, 22 bp, Artificial Sequence
  Synthetic construct
gagaatgagttatcttcagtct

SEQ ID NO: 10777 - DNA, 22 bp, Artificial Sequence
  Synthetic construct
agaatgagttatcttcagtctc

SEQ ID NO: 10778 - DNA, 22 bp, Artificial Sequence
  Synthetic construct
gaatgagttatcttcagtctca

SEQ ID NO: 10779 - DNA, 22 bp, Artificial Sequence
  Synthetic construct
aatgagttatcttcagtctcac

SEQ ID NO: 10780 - DNA, 22 bp, Artificial Sequence
  Synthetic construct
atgagttatcttcagtctcacc

SEQ ID NO: 10781 - DNA, 22 bp, Artificial Sequence
  Synthetic construct
tgagttatcttcagtctcaccg

SEQ ID NO: 10782 - DNA, 22 bp, Artificial Sequence
  Synthetic construct
gagttatcttcagtctcaccgt

SEQ ID NO: 10783 - DNA, 22 bp, Artificial Sequence
  Synthetic construct
agttatcttcagtctcaccgtc

SEQ ID NO: 10784 - DNA, 22 bp, Artificial Sequence
  Synthetic construct
gttatcttcagtctcaccgtcc

SEQ ID NO: 10785 - DNA, 22 bp, Artificial Sequence
  Synthetic construct
ttatcttcagtctcaccgtccg

SEQ ID NO: 10786 - DNA, 22 bp, Artificial Sequence
  Synthetic construct
tatcttcagtctcaccgtccgc

SEQ ID NO: 10787 - DNA, 22 bp, Artificial Sequence
  Synthetic construct
atcttcagtctcaccgtccgcg

SEQ ID NO: 10788 - DNA, 22 bp, Artificial Sequence
  Synthetic construct
tcttcagtctcaccgtccgcgt

SEQ ID NO: 10789 - DNA, 22 bp, Artificial Sequence
  Synthetic construct
cttcagtctcaccgtccgcgta

SEQ ID NO: 10790 - DNA, 22 bp, Artificial Sequence
  Synthetic construct
ttcagtctcaccgtccgcgtaa

SEQ ID NO: 10791 - DNA, 22 bp, Artificial Sequence
  Synthetic construct
tcagtctcaccgtccgcgtaaa

SEQ ID NO: 10792 - DNA, 22 bp, Artificial Sequence
  Synthetic construct
cagtctcaccgtccgcgtaaac

SEQ ID NO: 10793 - DNA, 22 bp, Artificial Sequence
  Synthetic construct
agtctcaccgtccgcgtaaacg

SEQ ID NO: 10794 - DNA, 22 bp, Artificial Sequence
  Synthetic construct
gtctcaccgtccgcgtaaacgc

SEQ ID NO: 10795 - DNA, 22 bp, Artificial Sequence
  Synthetic construct
tctcaccgtccgcgtaaacgcg

SEQ ID NO: 10796 - DNA, 22 bp, Artificial Sequence
  Synthetic construct
ctcaccgtccgcgtaaacgcga

SEQ ID NO: 10797 - DNA, 22 bp, Artificial Sequence
  Synthetic construct
tcaccgtccgcgtaaacgcgaa

SEQ ID NO: 10798 - DNA, 22 bp, Artificial Sequence
  Synthetic construct
caccgtccgcgtaaacgcgaac

SEQ ID NO: 10799 - DNA, 22 bp, Artificial Sequence
  Synthetic construct
accgtccgcgtaaacgcgaacg

SEQ ID NO: 10800 - DNA, 22 bp, Artificial Sequence
  Synthetic construct
ccgtccgcgtaaacgcgaacgg

SEQ ID NO: 10801 - DNA, 22 bp, Artificial Sequence
  Synthetic construct
cgtccgcgtaaacgcgaacgga

SEQ ID NO: 10802 - DNA, 22 bp, Artificial Sequence
  Synthetic construct
gtccgcgtaaacgcgaacggag

SEQ ID NO: 10803 - DNA, 22 bp, Artificial Sequence
  Synthetic construct
tccgcgtaaacgcgaacggagg

SEQ ID NO: 10804 - DNA, 22 bp, Artificial Sequence
  Synthetic construct
ccgcgtaaacgcgaacggaggg

SEQ ID NO: 10805 - DNA, 22 bp, Artificial Sequence
  Synthetic construct
cgcgtaaacgcgaacggagggg

SEQ ID NO: 10806 - DNA, 22 bp, Artificial Sequence
  Synthetic construct
gcgtaaacgcgaacggagggga

SEQ ID NO: 10807 - DNA, 22 bp, Artificial Sequence
  Synthetic construct
cgtaaacgcgaacggaggggac

SEQ ID NO: 10808 - DNA, 22 bp, Artificial Sequence
  Synthetic construct
gtaaacgcgaacggaggggacg

SEQ ID NO: 10809 - DNA, 22 bp, Artificial Sequence
  Synthetic construct
taaacgcgaacggaggggacga

SEQ ID NO: 10810 - DNA, 22 bp, Artificial Sequence
  Synthetic construct
aaacgcgaacggaggggacgaa

SEQ ID NO: 10811 - DNA, 22 bp, Artificial Sequence
  Synthetic construct
aacgcgaacggaggggacgaag

SEQ ID NO: 10812 - DNA, 22 bp, Artificial Sequence
  Synthetic construct
acgcgaacggaggggacgaagg

SEQ ID NO: 10813 - DNA, 22 bp, Artificial Sequence
  Synthetic construct
cgcgaacggaggggacgaaggt

SEQ ID NO: 10814 - DNA, 22 bp, Artificial Sequence
  Synthetic construct
gcgaacggaggggacgaaggtc

SEQ ID NO: 10815 - DNA, 22 bp, Artificial Sequence
  Synthetic construct
cgaacggaggggacgaaggtct

SEQ ID NO: 10816 - DNA, 22 bp, Artificial Sequence
  Synthetic construct
gaacggaggggacgaaggtctc

SEQ ID NO: 10817 - DNA, 22 bp, Artificial Sequence
  Synthetic construct
aacggaggggacgaaggtctcg

SEQ ID NO: 10818 - DNA, 22 bp, Artificial Sequence
  Synthetic construct
acggaggggacgaaggtctcgt

SEQ ID NO: 10819 - DNA, 22 bp, Artificial Sequence
  Synthetic construct
cggaggggacgaaggtctcgtt

SEQ ID NO: 10820 - DNA, 22 bp, Artificial Sequence
  Synthetic construct
ggaggggacgaaggtctcgttc

SEQ ID NO: 10821 - DNA, 22 bp, Artificial Sequence
  Synthetic construct
gaggggacgaaggtctcgttct

SEQ ID NO: 10822 - DNA, 22 bp, Artificial Sequence
  Synthetic construct
aggggacgaaggtctcgttctc

SEQ ID NO: 10823 - DNA, 22 bp, Artificial Sequence
  Synthetic construct
ggggacgaaggtctcgttctcc

SEQ ID NO: 10824 - DNA, 22 bp, Artificial Sequence
  Synthetic construct
gggacgaaggtctcgttctccc

SEQ ID NO: 10825 - DNA, 22 bp, Artificial Sequence
  Synthetic construct
ggacgaaggtctcgttctccct

SEQ ID NO: 10826 - DNA, 22 bp, Artificial Sequence
  Synthetic construct
gacgaaggtctcgttctcccta

SEQ ID NO: 10827 - DNA, 22 bp, Artificial Sequence
  Synthetic construct
acgaaggtctcgttctccctat

SEQ ID NO: 10828 - DNA, 22 bp, Artificial Sequence
  Synthetic construct
cgaaggtctcgttctccctatc

SEQ ID NO: 10829 - DNA, 22 bp, Artificial Sequence
  Synthetic construct
gaaggtctcgttctccctatca

SEQ ID NO: 10830 - DNA, 22 bp, Artificial Sequence
  Synthetic construct
aaggtctcgttctccctatcaa

SEQ ID NO: 10831 - DNA, 22 bp, Artificial Sequence
  Synthetic construct
aggtctcgttctccctatcaag

SEQ ID NO: 10832 - DNA, 22 bp, Artificial Sequence
  Synthetic construct
ggtctcgttctccctatcaagg

SEQ ID NO: 10833 - DNA, 22 bp, Artificial Sequence
  Synthetic construct
gtctcgttctccctatcaaggg

SEQ ID NO: 10834 - DNA, 22 bp, Artificial Sequence
  Synthetic construct
tctcgttctccctatcaagggt

SEQ ID NO: 10835 - DNA, 22 bp, Artificial Sequence
  Synthetic construct
ctcgttctccctatcaagggta

SEQ ID NO: 10836 - DNA, 22 bp, Artificial Sequence
  Synthetic construct
tcgttctccctatcaagggtac

SEQ ID NO: 10837 - DNA, 22 bp, Artificial Sequence
  Synthetic construct
cgttctccctatcaagggtact

SEQ ID NO: 10838 - DNA, 22 bp, Artificial Sequence
  Synthetic construct
gttctccctatcaagggtacta

SEQ ID NO: 10839 - DNA, 22 bp, Artificial Sequence
  Synthetic construct
ttctccctatcaagggtactaa

SEQ ID NO: 10840 - DNA, 22 bp, Artificial Sequence
  Synthetic construct
tctccctatcaagggtactaaa

SEQ ID NO: 10841 - DNA, 22 bp, Artificial Sequence
  Synthetic construct
ctccctatcaagggtactaaaa

SEQ ID NO: 10842 - DNA, 22 bp, Artificial Sequence
  Synthetic construct
tccctatcaagggtactaaaag

SEQ ID NO: 10843 - DNA, 22 bp, Artificial Sequence
  Synthetic construct
ccctatcaagggtactaaaagc

SEQ ID NO: 10844 - DNA, 22 bp, Artificial Sequence
  Synthetic construct
cctatcaagggtactaaaagct

SEQ ID NO: 10845 - DNA, 22 bp, Artificial Sequence
  Synthetic construct
ctatcaagggtactaaaagctc

SEQ ID NO: 10846 - DNA, 22 bp, Artificial Sequence
  Synthetic construct
tatcaagggtactaaaagctcg

SEQ ID NO: 10847 - DNA, 22 bp, Artificial Sequence
  Synthetic construct
atcaagggtactaaaagctcgc

SEQ ID NO: 10848 - DNA, 22 bp, Artificial Sequence
  Synthetic construct
tcaagggtactaaaagctcgca

SEQ ID NO: 10849 - DNA, 22 bp, Artificial Sequence
  Synthetic construct
caagggtactaaaagctcgcac

SEQ ID NO: 10850 - DNA, 22 bp, Artificial Sequence
  Synthetic construct
aagggtactaaaagctcgcaca

SEQ ID NO: 10851 - DNA, 22 bp, Artificial Sequence
  Synthetic construct
agggtactaaaagctcgcacag

SEQ ID NO: 10852 - DNA, 22 bp, Artificial Sequence
  Synthetic construct
gggtactaaaagctcgcacagg

SEQ ID NO: 10853 - DNA, 22 bp, Artificial Sequence
  Synthetic construct
ggtactaaaagctcgcacaggt

SEQ ID NO: 10854 - DNA, 22 bp, Artificial Sequence
  Synthetic construct
gtactaaaagctcgcacaggtc

SEQ ID NO: 10855 - DNA, 22 bp, Artificial Sequence
  Synthetic construct
tactaaaagctcgcacaggtca

SEQ ID NO: 10856 - DNA, 22 bp, Artificial Sequence
  Synthetic construct
actaaaagctcgcacaggtcaa

SEQ ID NO: 10857 - DNA, 22 bp, Artificial Sequence
  Synthetic construct
ctaaaagctcgcacaggtcaaa

SEQ ID NO: 10858 - DNA, 22 bp, Artificial Sequence
  Synthetic construct
taaaagctcgcacaggtcaaac

SEQ ID NO: 10859 - DNA, 22 bp, Artificial Sequence
  Synthetic construct
aaaagctcgcacaggtcaaacc

SEQ ID NO: 10860 - DNA, 22 bp, Artificial Sequence
  Synthetic construct
aaagctcgcacaggtcaaacct

SEQ ID NO: 10861 - DNA, 22 bp, Artificial Sequence
  Synthetic construct
aagctcgcacaggtcaaacctc

SEQ ID NO: 10862 - DNA, 22 bp, Artificial Sequence
  Synthetic construct
agctcgcacaggtcaaacctcc

SEQ ID NO: 10863 - DNA, 22 bp, Artificial Sequence
  Synthetic construct
gctcgcacaggtcaaacctcct

SEQ ID NO: 10864 - DNA, 22 bp, Artificial Sequence
  Synthetic construct
ctcgcacaggtcaaacctccta

SEQ ID NO: 10865 - DNA, 22 bp, Artificial Sequence
  Synthetic construct
tcgcacaggtcaaacctcctag

SEQ ID NO: 10866 - DNA, 22 bp, Artificial Sequence
  Synthetic construct
cgcacaggtcaaacctcctagg

SEQ ID NO: 10867 - DNA, 22 bp, Artificial Sequence
  Synthetic construct
gcacaggtcaaacctcctagga

SEQ ID NO: 10868 - DNA, 22 bp, Artificial Sequence
  Synthetic construct
cacaggtcaaacctcctaggaa

SEQ ID NO: 10869 - DNA, 22 bp, Artificial Sequence
  Synthetic construct
acaggtcaaacctcctaggaat

SEQ ID NO: 10870 - DNA, 22 bp, Artificial Sequence
  Synthetic construct
caggtcaaacctcctaggaatg

SEQ ID NO: 10871 - DNA, 22 bp, Artificial Sequence
  Synthetic construct
aggtcaaacctcctaggaatgg

SEQ ID NO: 10872 - DNA, 22 bp, Artificial Sequence
  Synthetic construct
ggtcaaacctcctaggaatgga

SEQ ID NO: 10873 - DNA, 22 bp, Artificial Sequence
  Synthetic construct
gtcaaacctcctaggaatggaa

SEQ ID NO: 10874 - DNA, 22 bp, Artificial Sequence
  Synthetic construct
tcaaacctcctaggaatggaat

SEQ ID NO: 10875 - DNA, 22 bp, Artificial Sequence
  Synthetic construct
caaacctcctaggaatggaatt

SEQ ID NO: 10876 - DNA, 22 bp, Artificial Sequence
  Synthetic construct
aaacctcctaggaatggaattc

SEQ ID NO: 10877 - DNA, 22 bp, Artificial Sequence
  Synthetic construct
aacctcctaggaatggaattcc

SEQ ID NO: 10878 - DNA, 22 bp, Artificial Sequence
  Synthetic construct
acctcctaggaatggaattccg

SEQ ID NO: 10879 - DNA, 22 bp, Artificial Sequence
  Synthetic construct
cctcctaggaatggaattccgg

SEQ ID NO: 10880 - DNA, 22 bp, Artificial Sequence
  Synthetic construct
ctcctaggaatggaattccggc

SEQ ID NO: 10881 - DNA, 22 bp, Artificial Sequence
  Synthetic construct
tcctaggaatggaattccggct

SEQ ID NO: 10882 - DNA, 22 bp, Artificial Sequence
  Synthetic construct
cctaggaatggaattccggcta

SEQ ID NO: 10883 - DNA, 22 bp, Artificial Sequence
  Synthetic construct
ctaggaatggaattccggctac

SEQ ID NO: 10884 - DNA, 22 bp, Artificial Sequence
  Synthetic construct
taggaatggaattccggctacc

SEQ ID NO: 10885 - DNA, 22 bp, Artificial Sequence
  Synthetic construct
aggaatggaattccggctacct

SEQ ID NO: 10886 - DNA, 22 bp, Artificial Sequence
  Synthetic construct
ggaatggaattccggctaccta

SEQ ID NO: 10887 - DNA, 22 bp, Artificial Sequence
  Synthetic construct
gaatggaattccggctacctac

SEQ ID NO: 10888 - DNA, 22 bp, Artificial Sequence
  Synthetic construct
aatggaattccggctacctaca

SEQ ID NO: 10889 - DNA, 22 bp, Artificial Sequence
  Synthetic construct
atggaattccggctacctacag

SEQ ID NO: 10890 - DNA, 22 bp, Artificial Sequence
  Synthetic construct
tggaattccggctacctacagc

SEQ ID NO: 10891 - DNA, 22 bp, Artificial Sequence
  Synthetic construct
ggaattccggctacctacagcg

SEQ ID NO: 10892 - DNA, 22 bp, Artificial Sequence
  Synthetic construct
gaattccggctacctacagcga

SEQ ID NO: 10893 - DNA, 22 bp, Artificial Sequence
  Synthetic construct
aattccggctacctacagcgat

SEQ ID NO: 10894 - DNA, 22 bp, Artificial Sequence
  Synthetic construct
attccggctacctacagcgata

SEQ ID NO: 10895 - DNA, 22 bp, Artificial Sequence
  Synthetic construct
ttccggctacctacagcgatag

SEQ ID NO: 10896 - DNA, 22 bp, Artificial Sequence
  Synthetic construct
tccggctacctacagcgatagc

SEQ ID NO: 10897 - DNA, 22 bp, Artificial Sequence
  Synthetic construct
ccggctacctacagcgatagcc

SEQ ID NO: 10898 - DNA, 22 bp, Artificial Sequence
  Synthetic construct
cggctacctacagcgatagcca

SEQ ID NO: 10899 - DNA, 22 bp, Artificial Sequence
  Synthetic construct
ggctacctacagcgatagccat

SEQ ID NO: 10900 - DNA, 22 bp, Artificial Sequence
  Synthetic construct
gctacctacagcgatagccatg

SEQ ID NO: 10901 - DNA, 22 bp, Artificial Sequence
  Synthetic construct
ctacctacagcgatagccatgg

SEQ ID NO: 10902 - DNA, 22 bp, Artificial Sequence
  Synthetic construct
tacctacagcgatagccatggt

SEQ ID NO: 10903 - DNA, 22 bp, Artificial Sequence
  Synthetic construct
acctacagcgatagccatggta

SEQ ID NO: 10904 - DNA, 22 bp, Artificial Sequence
  Synthetic construct
cctacagcgatagccatggtag

SEQ ID NO: 10905 - DNA, 22 bp, Artificial Sequence
  Synthetic construct
ctacagcgatagccatggtagc

SEQ ID NO: 10906 - DNA, 22 bp, Artificial Sequence
  Synthetic construct
tacagcgatagccatggtagcg

SEQ ID NO: 10907 - DNA, 22 bp, Artificial Sequence
  Synthetic construct
acagcgatagccatggtagcgt

SEQ ID NO: 10908 - DNA, 22 bp, Artificial Sequence
  Synthetic construct
cagcgatagccatggtagcgtc

SEQ ID NO: 10909 - DNA, 22 bp, Artificial Sequence
  Synthetic construct
agcgatagccatggtagcgtct

SEQ ID NO: 10910 - DNA, 22 bp, Artificial Sequence
  Synthetic construct
gcgatagccatggtagcgtctc

SEQ ID NO: 10911 - DNA, 22 bp, Artificial Sequence
  Synthetic construct
cgatagccatggtagcgtctcg

SEQ ID NO: 10912 - DNA, 22 bp, Artificial Sequence
  Synthetic construct
gatagccatggtagcgtctcgc

SEQ ID NO: 10913 - DNA, 22 bp, Artificial Sequence
  Synthetic construct
atagccatggtagcgtctcgct

SEQ ID NO: 10914 - DNA, 22 bp, Artificial Sequence
  Synthetic construct
tagccatggtagcgtctcgcta

SEQ ID NO: 10915 - DNA, 22 bp, Artificial Sequence
  Synthetic construct
agccatggtagcgtctcgctaa

SEQ ID NO: 10916 - DNA, 22 bp, Artificial Sequence
  Synthetic construct
gccatggtagcgtctcgctaaa

SEQ ID NO: 10917 - DNA, 22 bp, Artificial Sequence
  Synthetic construct
ccatggtagcgtctcgctaaag

SEQ ID NO: 10918 - DNA, 22 bp, Artificial Sequence
  Synthetic construct
catggtagcgtctcgctaaaga

SEQ ID NO: 10919 - DNA, 22 bp, Artificial Sequence
  Synthetic construct
atggtagcgtctcgctaaagac

SEQ ID NO: 10920 - DNA, 22 bp, Artificial Sequence
  Synthetic construct
tggtagcgtctcgctaaagaca

SEQ ID NO: 10921 - DNA, 22 bp, Artificial Sequence
  Synthetic construct
ggtagcgtctcgctaaagacat

SEQ ID NO: 10922 - DNA, 22 bp, Artificial Sequence
  Synthetic construct
gtagcgtctcgctaaagacatt

SEQ ID NO: 10923 - DNA, 22 bp, Artificial Sequence
  Synthetic construct
tagcgtctcgctaaagacatta

SEQ ID NO: 10924 - DNA, 22 bp, Artificial Sequence
  Synthetic construct
agcgtctcgctaaagacattaa

SEQ ID NO: 10925 - DNA, 22 bp, Artificial Sequence
  Synthetic construct
gcgtctcgctaaagacattaaa

SEQ ID NO: 10926 - DNA, 22 bp, Artificial Sequence
  Synthetic construct
cgtctcgctaaagacattaaaa

SEQ ID NO: 10927 - DNA, 22 bp, Artificial Sequence
  Synthetic construct
gtctcgctaaagacattaaaaa

SEQ ID NO: 10928 - DNA, 22 bp, Artificial Sequence
  Synthetic construct
tctcgctaaagacattaaaaat

SEQ ID NO: 10929 - DNA, 22 bp, Artificial Sequence
  Synthetic construct
ctcgctaaagacattaaaaatg

SEQ ID NO: 10930 - DNA, 22 bp, Artificial Sequence
  Synthetic construct
tcgctaaagacattaaaaatgg

SEQ ID NO: 10931 - DNA, 22 bp, Artificial Sequence
  Synthetic construct
cgctaaagacattaaaaatggc

SEQ ID NO: 10932 - DNA, 22 bp, Artificial Sequence
  Synthetic construct
gctaaagacattaaaaatggca

SEQ ID NO: 10933 - DNA, 22 bp, Artificial Sequence
  Synthetic construct
ctaaagacattaaaaatggcat

SEQ ID NO: 10934 - DNA, 22 bp, Artificial Sequence
  Synthetic construct
taaagacattaaaaatggcatt

SEQ ID NO: 10935 - DNA, 22 bp, Artificial Sequence
  Synthetic construct
aaagacattaaaaatggcatta

SEQ ID NO: 10936 - DNA, 22 bp, Artificial Sequence
  Synthetic construct
aagacattaaaaatggcattag

SEQ ID NO: 10937 - DNA, 22 bp, Artificial Sequence
  Synthetic construct
agacattaaaaatggcattagc

SEQ ID NO: 10938 - DNA, 22 bp, Artificial Sequence
  Synthetic construct
gacattaaaaatggcattagct

SEQ ID NO: 10939 - DNA, 22 bp, Artificial Sequence
  Synthetic construct
acattaaaaatggcattagctc

SEQ ID NO: 10940 - DNA, 22 bp, Artificial Sequence
  Synthetic construct
cattaaaaatggcattagctcg

SEQ ID NO: 10941 - DNA, 22 bp, Artificial Sequence
  Synthetic construct
attaaaaatggcattagctcga

SEQ ID NO: 10942 - DNA, 22 bp, Artificial Sequence
  Synthetic construct
ttaaaaatggcattagctcgac

SEQ ID NO: 10943 - DNA, 22 bp, Artificial Sequence
  Synthetic construct
taaaaatggcattagctcgaca

SEQ ID NO: 10944 - DNA, 22 bp, Artificial Sequence
  Synthetic construct
aaaaatggcattagctcgacag

SEQ ID NO: 10945 - DNA, 22 bp, Artificial Sequence
  Synthetic construct
aaaatggcattagctcgacagg

SEQ ID NO: 10946 - DNA, 22 bp, Artificial Sequence
  Synthetic construct
aaatggcattagctcgacagga

SEQ ID NO: 10947 - DNA, 22 bp, Artificial Sequence
  Synthetic construct
aatggcattagctcgacaggaa

SEQ ID NO: 10948 - DNA, 22 bp, Artificial Sequence
  Synthetic construct
atggcattagctcgacaggaag

SEQ ID NO: 10949 - DNA, 22 bp, Artificial Sequence
  Synthetic construct
tggcattagctcgacaggaagt

SEQ ID NO: 10950 - DNA, 22 bp, Artificial Sequence
  Synthetic construct
ggcattagctcgacaggaagtt

SEQ ID NO: 10951 - DNA, 22 bp, Artificial Sequence
  Synthetic construct
gcattagctcgacaggaagttg

SEQ ID NO: 10952 - DNA, 22 bp, Artificial Sequence
  Synthetic construct
cattagctcgacaggaagttga

SEQ ID NO: 10953 - DNA, 22 bp, Artificial Sequence
  Synthetic construct
attagctcgacaggaagttgag

SEQ ID NO: 10954 - DNA, 22 bp, Artificial Sequence
  Synthetic construct
ttagctcgacaggaagttgagc

SEQ ID NO: 10955 - DNA, 22 bp, Artificial Sequence
  Synthetic construct
tagctcgacaggaagttgagca

SEQ ID NO: 10956 - DNA, 22 bp, Artificial Sequence
  Synthetic construct
agctcgacaggaagttgagcag

SEQ ID NO: 10957 - DNA, 22 bp, Artificial Sequence
  Synthetic construct
gctcgacaggaagttgagcagg

SEQ ID NO: 10958 - DNA, 22 bp, Artificial Sequence
  Synthetic construct
ctcgacaggaagttgagcagga

SEQ ID NO: 10959 - DNA, 22 bp, Artificial Sequence
  Synthetic construct
tcgacaggaagttgagcaggac

SEQ ID NO: 10960 - DNA, 22 bp, Artificial Sequence
  Synthetic construct
cgacaggaagttgagcaggacc

SEQ ID NO: 10961 - DNA, 22 bp, Artificial Sequence
  Synthetic construct
gacaggaagttgagcaggaccc

SEQ ID NO: 10962 - DNA, 22 bp, Artificial Sequence
  Synthetic construct
acaggaagttgagcaggacccc

SEQ ID NO: 10963 - DNA, 22 bp, Artificial Sequence
  Synthetic construct
caggaagttgagcaggaccccg

SEQ ID NO: 10964 - DNA, 22 bp, Artificial Sequence
  Synthetic construct
aggaagttgagcaggaccccga

SEQ ID NO: 10965 - DNA, 22 bp, Artificial Sequence
  Synthetic construct
ggaagttgagcaggaccccgaa

SEQ ID NO: 10966 - DNA, 22 bp, Artificial Sequence
  Synthetic construct
gaagttgagcaggaccccgaaa

SEQ ID NO: 10967 - DNA, 22 bp, Artificial Sequence
  Synthetic construct
aagttgagcaggaccccgaaag

SEQ ID NO: 10968 - DNA, 22 bp, Artificial Sequence
  Synthetic construct
agttgagcaggaccccgaaagg

SEQ ID NO: 10969 - DNA, 22 bp, Artificial Sequence
  Synthetic construct
gttgagcaggaccccgaaaggg

SEQ ID NO: 10970 - DNA, 22 bp, Artificial Sequence
  Synthetic construct
ttgagcaggaccccgaaagggg

SEQ ID NO: 10971 - DNA, 22 bp, Artificial Sequence
  Synthetic construct
tgagcaggaccccgaaaggggt

SEQ ID NO: 10972 - DNA, 22 bp, Artificial Sequence
  Synthetic construct
gagcaggaccccgaaaggggtc

SEQ ID NO: 10973 - DNA, 22 bp, Artificial Sequence
  Synthetic construct
agcaggaccccgaaaggggtcc

SEQ ID NO: 10974 - DNA, 22 bp, Artificial Sequence
  Synthetic construct
gcaggaccccgaaaggggtccc

SEQ ID NO: 10975 - DNA, 22 bp, Artificial Sequence
  Synthetic construct
caggaccccgaaaggggtccca

SEQ ID NO: 10976 - DNA, 22 bp, Artificial Sequence
  Synthetic construct
aggaccccgaaaggggtcccac

SEQ ID NO: 10977 - DNA, 22 bp, Artificial Sequence
  Synthetic construct
ggaccccgaaaggggtcccacc

SEQ ID NO: 10978 - DNA, 23 bp, Artificial Sequence
  Synthetic construct
tgggtggtaactagccaagcagc

SEQ ID NO: 10979 - DNA, 23 bp, Artificial Sequence
  Synthetic construct
gggtggtaactagccaagcagct

SEQ ID NO: 10980 - DNA, 23 bp, Artificial Sequence
  Synthetic construct
ggtggtaactagccaagcagcta

SEQ ID NO: 10981 - DNA, 23 bp, Artificial Sequence
  Synthetic construct
gtggtaactagccaagcagctag

SEQ ID NO: 10982 - DNA, 23 bp, Artificial Sequence
  Synthetic construct
tggtaactagccaagcagctagt

SEQ ID NO: 10983 - DNA, 23 bp, Artificial Sequence
  Synthetic construct
ggtaactagccaagcagctagtt

SEQ ID NO: 10984 - DNA, 23 bp, Artificial Sequence
  Synthetic construct
gtaactagccaagcagctagtta

SEQ ID NO: 10985 - DNA, 23 bp, Artificial Sequence
  Synthetic construct
taactagccaagcagctagttac

SEQ ID NO: 10986 - DNA, 23 bp, Artificial Sequence
  Synthetic construct
aactagccaagcagctagttacc

SEQ ID NO: 10987 - DNA, 23 bp, Artificial Sequence
  Synthetic construct
actagccaagcagctagttacca

SEQ ID NO: 10988 - DNA, 23 bp, Artificial Sequence
  Synthetic construct
ctagccaagcagctagttaccaa

SEQ ID NO: 10989 - DNA, 23 bp, Artificial Sequence
  Synthetic construct
tagccaagcagctagttaccaaa

SEQ ID NO: 10990 - DNA, 23 bp, Artificial Sequence
  Synthetic construct
agccaagcagctagttaccaaat

SEQ ID NO: 10991 - DNA, 23 bp, Artificial Sequence
  Synthetic construct
gccaagcagctagttaccaaatc

SEQ ID NO: 10992 - DNA, 23 bp, Artificial Sequence
  Synthetic construct
ccaagcagctagttaccaaatcg

SEQ ID NO: 10993 - DNA, 23 bp, Artificial Sequence
  Synthetic construct
caagcagctagttaccaaatcgg

SEQ ID NO: 10994 - DNA, 23 bp, Artificial Sequence
  Synthetic construct
aagcagctagttaccaaatcggg

SEQ ID NO: 10995 - DNA, 23 bp, Artificial Sequence
  Synthetic construct
agcagctagttaccaaatcggga

SEQ ID NO: 10996 - DNA, 23 bp, Artificial Sequence
  Synthetic construct
gcagctagttaccaaatcgggag

SEQ ID NO: 10997 - DNA, 23 bp, Artificial Sequence
  Synthetic construct
cagctagttaccaaatcgggaga

SEQ ID NO: 10998 - DNA, 23 bp, Artificial Sequence
  Synthetic construct
agctagttaccaaatcgggagaa

SEQ ID NO: 10999 - DNA, 23 bp, Artificial Sequence
  Synthetic construct
gctagttaccaaatcgggagaat

SEQ ID NO: 11000 - DNA, 23 bp, Artificial Sequence
  Synthetic construct
ctagttaccaaatcgggagaatc

SEQ ID NO: 11001 - DNA, 23 bp, Artificial Sequence
  Synthetic construct
tagttaccaaatcgggagaatcc

SEQ ID NO: 11002 - DNA, 23 bp, Artificial Sequence
  Synthetic construct
agttaccaaatcgggagaatccc

SEQ ID NO: 11003 - DNA, 23 bp, Artificial Sequence
  Synthetic construct
gttaccaaatcgggagaatcccg

SEQ ID NO: 11004 - DNA, 23 bp, Artificial Sequence
  Synthetic construct
ttaccaaatcgggagaatcccgg

SEQ ID NO: 11005 - DNA, 23 bp, Artificial Sequence
  Synthetic construct
taccaaatcgggagaatcccggg

SEQ ID NO: 11006 - DNA, 23 bp, Artificial Sequence
  Synthetic construct
accaaatcgggagaatcccgggt

SEQ ID NO: 11007 - DNA, 23 bp, Artificial Sequence
  Synthetic construct
ccaaatcgggagaatcccgggtc

SEQ ID NO: 11008 - DNA, 23 bp, Artificial Sequence
  Synthetic construct
caaatcgggagaatcccgggtcc

SEQ ID NO: 11009 - DNA, 23 bp, Artificial Sequence
  Synthetic construct
aaatcgggagaatcccgggtcct

SEQ ID NO: 11010 - DNA, 23 bp, Artificial Sequence
  Synthetic construct
aatcgggagaatcccgggtcctc

SEQ ID NO: 11011 - DNA, 23 bp, Artificial Sequence
  Synthetic construct
atcgggagaatcccgggtcctct

SEQ ID NO: 11012 - DNA, 23 bp, Artificial Sequence
  Synthetic construct
tcgggagaatcccgggtcctctc

SEQ ID NO: 11013 - DNA, 23 bp, Artificial Sequence
  Synthetic construct
cgggagaatcccgggtcctctct

SEQ ID NO: 11014 - DNA, 23 bp, Artificial Sequence
  Synthetic construct
gggagaatcccgggtcctctctt

SEQ ID NO: 11015 - DNA, 23 bp, Artificial Sequence
  Synthetic construct
ggagaatcccgggtcctctcttt

SEQ ID NO: 11016 - DNA, 23 bp, Artificial Sequence
  Synthetic construct
gagaatcccgggtcctctcttta

SEQ ID NO: 11017 - DNA, 23 bp, Artificial Sequence
  Synthetic construct
agaatcccgggtcctctctttag

SEQ ID NO: 11018 - DNA, 23 bp, Artificial Sequence
  Synthetic construct
gaatcccgggtcctctctttagg

SEQ ID NO: 11019 - DNA, 23 bp, Artificial Sequence
  Synthetic construct
aatcccgggtcctctctttaggg

SEQ ID NO: 11020 - DNA, 23 bp, Artificial Sequence
  Synthetic construct
atcccgggtcctctctttagggg

SEQ ID NO: 11021 - DNA, 23 bp, Artificial Sequence
  Synthetic construct
tcccgggtcctctctttaggggg

SEQ ID NO: 11022 - DNA, 23 bp, Artificial Sequence
  Synthetic construct
cccgggtcctctctttaggggga

SEQ ID NO: 11023 - DNA, 23 bp, Artificial Sequence
  Synthetic construct
ccgggtcctctctttagggggag

SEQ ID NO: 11024 - DNA, 23 bp, Artificial Sequence
  Synthetic construct
cgggtcctctctttagggggagg

SEQ ID NO: 11025 - DNA, 23 bp, Artificial Sequence
  Synthetic construct
gggtcctctctttagggggaggt

SEQ ID NO: 11026 - DNA, 23 bp, Artificial Sequence
  Synthetic construct
ggtcctctctttagggggaggtc

SEQ ID NO: 11027 - DNA, 23 bp, Artificial Sequence
  Synthetic construct
gtcctctctttagggggaggtcc

SEQ ID NO: 11028 - DNA, 23 bp, Artificial Sequence
  Synthetic construct
tcctctctttagggggaggtccc

SEQ ID NO: 11029 - DNA, 23 bp, Artificial Sequence
  Synthetic construct
cctctctttagggggaggtccct

SEQ ID NO: 11030 - DNA, 23 bp, Artificial Sequence
  Synthetic construct
ctctctttagggggaggtccctg

SEQ ID NO: 11031 - DNA, 23 bp, Artificial Sequence
  Synthetic construct
tctctttagggggaggtccctgg

SEQ ID NO: 11032 - DNA, 23 bp, Artificial Sequence
  Synthetic construct
ctctttagggggaggtccctggg

SEQ ID NO: 11033 - DNA, 23 bp, Artificial Sequence
  Synthetic construct
tctttagggggaggtccctgggc

SEQ ID NO: 11034 - DNA, 23 bp, Artificial Sequence
  Synthetic construct
ctttagggggaggtccctgggcc

SEQ ID NO: 11035 - DNA, 23 bp, Artificial Sequence
  Synthetic construct
tttagggggaggtccctgggccg

SEQ ID NO: 11036 - DNA, 23 bp, Artificial Sequence
  Synthetic construct
ttagggggaggtccctgggccga

SEQ ID NO: 11037 - DNA, 23 bp, Artificial Sequence
  Synthetic construct
tagggggaggtccctgggccgaa

SEQ ID NO: 11038 - DNA, 23 bp, Artificial Sequence
  Synthetic construct
agggggaggtccctgggccgaag

SEQ ID NO: 11039 - DNA, 23 bp, Artificial Sequence
  Synthetic construct
gggggaggtccctgggccgaagc

SEQ ID NO: 11040 - DNA, 23 bp, Artificial Sequence
  Synthetic construct
ggggaggtccctgggccgaagcc

SEQ ID NO: 11041 - DNA, 23 bp, Artificial Sequence
  Synthetic construct
gggaggtccctgggccgaagccc

SEQ ID NO: 11042 - DNA, 23 bp, Artificial Sequence
  Synthetic construct
ggaggtccctgggccgaagcccg

SEQ ID NO: 11043 - DNA, 23 bp, Artificial Sequence
  Synthetic construct
gaggtccctgggccgaagcccgc

SEQ ID NO: 11044 - DNA, 23 bp, Artificial Sequence
  Synthetic construct
aggtccctgggccgaagcccgcc

SEQ ID NO: 11045 - DNA, 23 bp, Artificial Sequence
  Synthetic construct
ggtccctgggccgaagcccgccc

SEQ ID NO: 11046 - DNA, 23 bp, Artificial Sequence
  Synthetic construct
gtccctgggccgaagcccgccca

SEQ ID NO: 11047 - DNA, 23 bp, Artificial Sequence
  Synthetic construct
tccctgggccgaagcccgcccac

SEQ ID NO: 11048 - DNA, 23 bp, Artificial Sequence
  Synthetic construct
ccctgggccgaagcccgcccacc

SEQ ID NO: 11049 - DNA, 23 bp, Artificial Sequence
  Synthetic construct
cctgggccgaagcccgcccacct

SEQ ID NO: 11050 - DNA, 23 bp, Artificial Sequence
  Synthetic construct
ctgggccgaagcccgcccacctt

SEQ ID NO: 11051 - DNA, 23 bp, Artificial Sequence
  Synthetic construct
tgggccgaagcccgcccaccttt

SEQ ID NO: 11052 - DNA, 23 bp, Artificial Sequence
  Synthetic construct
gggccgaagcccgcccacctttc

SEQ ID NO: 11053 - DNA, 23 bp, Artificial Sequence
  Synthetic construct
ggccgaagcccgcccacctttcg

SEQ ID NO: 11054 - DNA, 23 bp, Artificial Sequence
  Synthetic construct
gccgaagcccgcccacctttcgg

SEQ ID NO: 11055 - DNA, 23 bp, Artificial Sequence
  Synthetic construct
ccgaagcccgcccacctttcggt

SEQ ID NO: 11056 - DNA, 23 bp, Artificial Sequence
  Synthetic construct
cgaagcccgcccacctttcggtg

SEQ ID NO: 11057 - DNA, 23 bp, Artificial Sequence
  Synthetic construct
gaagcccgcccacctttcggtgg

SEQ ID NO: 11058 - DNA, 23 bp, Artificial Sequence
  Synthetic construct
aagcccgcccacctttcggtgga

SEQ ID NO: 11059 - DNA, 23 bp, Artificial Sequence
  Synthetic construct
agcccgcccacctttcggtggag

SEQ ID NO: 11060 - DNA, 23 bp, Artificial Sequence
  Synthetic construct
gcccgcccacctttcggtggagc

SEQ ID NO: 11061 - DNA, 23 bp, Artificial Sequence
  Synthetic construct
cccgcccacctttcggtggagcc

SEQ ID NO: 11062 - DNA, 23 bp, Artificial Sequence
  Synthetic construct
ccgcccacctttcggtggagccg

SEQ ID NO: 11063 - DNA, 23 bp, Artificial Sequence
  Synthetic construct
cgcccacctttcggtggagccgg

SEQ ID NO: 11064 - DNA, 23 bp, Artificial Sequence
  Synthetic construct
gcccacctttcggtggagccgga

SEQ ID NO: 11065 - DNA, 23 bp, Artificial Sequence
  Synthetic construct
cccacctttcggtggagccggac

SEQ ID NO: 11066 - DNA, 23 bp, Artificial Sequence
  Synthetic construct
ccacctttcggtggagccggacc

SEQ ID NO: 11067 - DNA, 23 bp, Artificial Sequence
  Synthetic construct
cacctttcggtggagccggaccg

SEQ ID NO: 11068 - DNA, 23 bp, Artificial Sequence
  Synthetic construct
acctttcggtggagccggaccgc

SEQ ID NO: 11069 - DNA, 23 bp, Artificial Sequence
  Synthetic construct
cctttcggtggagccggaccgct

SEQ ID NO: 11070 - DNA, 23 bp, Artificial Sequence
  Synthetic construct
ctttcggtggagccggaccgctt

SEQ ID NO: 11071 - DNA, 23 bp, Artificial Sequence
  Synthetic construct
tttcggtggagccggaccgcttt

SEQ ID NO: 11072 - DNA, 23 bp, Artificial Sequence
  Synthetic construct
ttcggtggagccggaccgctttc

SEQ ID NO: 11073 - DNA, 23 bp, Artificial Sequence
  Synthetic construct
tcggtggagccggaccgctttcg

SEQ ID NO: 11074 - DNA, 23 bp, Artificial Sequence
  Synthetic construct
cggtggagccggaccgctttcgc

SEQ ID NO: 11075 - DNA, 23 bp, Artificial Sequence
  Synthetic construct
ggtggagccggaccgctttcgca

SEQ ID NO: 11076 - DNA, 23 bp, Artificial Sequence
  Synthetic construct
gtggagccggaccgctttcgcac

SEQ ID NO: 11077 - DNA, 23 bp, Artificial Sequence
  Synthetic construct
tggagccggaccgctttcgcacc

SEQ ID NO: 11078 - DNA, 23 bp, Artificial Sequence
  Synthetic construct
ggagccggaccgctttcgcaccc

SEQ ID NO: 11079 - DNA, 23 bp, Artificial Sequence
  Synthetic construct
gagccggaccgctttcgcacccg

SEQ ID NO: 11080 - DNA, 23 bp, Artificial Sequence
  Synthetic construct
agccggaccgctttcgcacccgt

SEQ ID NO: 11081 - DNA, 23 bp, Artificial Sequence
  Synthetic construct
gccggaccgctttcgcacccgtg

SEQ ID NO: 11082 - DNA, 23 bp, Artificial Sequence
  Synthetic construct
ccggaccgctttcgcacccgtgc

SEQ ID NO: 11083 - DNA, 23 bp, Artificial Sequence
  Synthetic construct
cggaccgctttcgcacccgtgct

SEQ ID NO: 11084 - DNA, 23 bp, Artificial Sequence
  Synthetic construct
ggaccgctttcgcacccgtgctc

SEQ ID NO: 11085 - DNA, 23 bp, Artificial Sequence
  Synthetic construct
gaccgctttcgcacccgtgctct

SEQ ID NO: 11086 - DNA, 23 bp, Artificial Sequence
  Synthetic construct
accgctttcgcacccgtgctctt

SEQ ID NO: 11087 - DNA, 23 bp, Artificial Sequence
  Synthetic construct
ccgctttcgcacccgtgctcttt

SEQ ID NO: 11088 - DNA, 23 bp, Artificial Sequence
  Synthetic construct
cgctttcgcacccgtgctctttc

SEQ ID NO: 11089 - DNA, 23 bp, Artificial Sequence
  Synthetic construct
gctttcgcacccgtgctctttcg

SEQ ID NO: 11090 - DNA, 23 bp, Artificial Sequence
  Synthetic construct
ctttcgcacccgtgctctttcga

SEQ ID NO: 11091 - DNA, 23 bp, Artificial Sequence
  Synthetic construct
tttcgcacccgtgctctttcgag

SEQ ID NO: 11092 - DNA, 23 bp, Artificial Sequence
  Synthetic construct
ttcgcacccgtgctctttcgagc

SEQ ID NO: 11093 - DNA, 23 bp, Artificial Sequence
  Synthetic construct
tcgcacccgtgctctttcgagca

SEQ ID NO: 11094 - DNA, 23 bp, Artificial Sequence
  Synthetic construct
cgcacccgtgctctttcgagcac

SEQ ID NO: 11095 - DNA, 23 bp, Artificial Sequence
  Synthetic construct
gcacccgtgctctttcgagcaca

SEQ ID NO: 11096 - DNA, 23 bp, Artificial Sequence
  Synthetic construct
cacccgtgctctttcgagcacac

SEQ ID NO: 11097 - DNA, 23 bp, Artificial Sequence
  Synthetic construct
acccgtgctctttcgagcacacc

SEQ ID NO: 11098 - DNA, 23 bp, Artificial Sequence
  Synthetic construct
cccgtgctctttcgagcacaccc

SEQ ID NO: 11099 - DNA, 23 bp, Artificial Sequence
  Synthetic construct
ccgtgctctttcgagcacaccca

SEQ ID NO: 11100 - DNA, 23 bp, Artificial Sequence
  Synthetic construct
cgtgctctttcgagcacacccac

SEQ ID NO: 11101 - DNA, 23 bp, Artificial Sequence
  Synthetic construct
gtgctctttcgagcacacccacc

SEQ ID NO: 11102 - DNA, 23 bp, Artificial Sequence
  Synthetic construct
tgctctttcgagcacacccaccc

SEQ ID NO: 11103 - DNA, 23 bp, Artificial Sequence
  Synthetic construct
gctctttcgagcacacccacccc

SEQ ID NO: 11104 - DNA, 23 bp, Artificial Sequence
  Synthetic construct
ctctttcgagcacacccaccccg

SEQ ID NO: 11105 - DNA, 23 bp, Artificial Sequence
  Synthetic construct
tctttcgagcacacccaccccgt

SEQ ID NO: 11106 - DNA, 23 bp, Artificial Sequence
  Synthetic construct
ctttcgagcacacccaccccgtt

SEQ ID NO: 11107 - DNA, 23 bp, Artificial Sequence
  Synthetic construct
tttcgagcacacccaccccgttt

SEQ ID NO: 11108 - DNA, 23 bp, Artificial Sequence
  Synthetic construct
ttcgagcacacccaccccgttta

SEQ ID NO: 11109 - DNA, 23 bp, Artificial Sequence
  Synthetic construct
tcgagcacacccaccccgtttac

SEQ ID NO: 11110 - DNA, 23 bp, Artificial Sequence
  Synthetic construct
cgagcacacccaccccgtttacg

SEQ ID NO: 11111 - DNA, 23 bp, Artificial Sequence
  Synthetic construct
gagcacacccaccccgtttacgg

SEQ ID NO: 11112 - DNA, 23 bp, Artificial Sequence
  Synthetic construct
agcacacccaccccgtttacggg

SEQ ID NO: 11113 - DNA, 23 bp, Artificial Sequence
  Synthetic construct
gcacacccaccccgtttacgggg

SEQ ID NO: 11114 - DNA, 23 bp, Artificial Sequence
  Synthetic construct
cacacccaccccgtttacggggg

SEQ ID NO: 11115 - DNA, 23 bp, Artificial Sequence
  Synthetic construct
acacccaccccgtttacgggggt

SEQ ID NO: 11116 - DNA, 23 bp, Artificial Sequence
  Synthetic construct
cacccaccccgtttacgggggtc

SEQ ID NO: 11117 - DNA, 23 bp, Artificial Sequence
  Synthetic construct
acccaccccgtttacgggggtcc

SEQ ID NO: 11118 - DNA, 23 bp, Artificial Sequence
  Synthetic construct
cccaccccgtttacgggggtccc

SEQ ID NO: 11119 - DNA, 23 bp, Artificial Sequence
  Synthetic construct
ccaccccgtttacgggggtccct

SEQ ID NO: 11120 - DNA, 23 bp, Artificial Sequence
  Synthetic construct
caccccgtttacgggggtccctc

SEQ ID NO: 11121 - DNA, 23 bp, Artificial Sequence
  Synthetic construct
accccgtttacgggggtccctcg

SEQ ID NO: 11122 - DNA, 23 bp, Artificial Sequence
  Synthetic construct
ccccgtttacgggggtccctcgg

SEQ ID NO: 11123 - DNA, 23 bp, Artificial Sequence
  Synthetic construct
cccgtttacgggggtccctcggt

SEQ ID NO: 11124 - DNA, 23 bp, Artificial Sequence
  Synthetic construct
ccgtttacgggggtccctcggtc

SEQ ID NO: 11125 - DNA, 23 bp, Artificial Sequence
  Synthetic construct
cgtttacgggggtccctcggtca

SEQ ID NO: 11126 - DNA, 23 bp, Artificial Sequence
  Synthetic construct
gtttacgggggtccctcggtcag

SEQ ID NO: 11127 - DNA, 23 bp, Artificial Sequence
  Synthetic construct
tttacgggggtccctcggtcagc

SEQ ID NO: 11128 - DNA, 23 bp, Artificial Sequence
  Synthetic construct
ttacgggggtccctcggtcagct

SEQ ID NO: 11129 - DNA, 23 bp, Artificial Sequence
  Synthetic construct
tacgggggtccctcggtcagcta

SEQ ID NO: 11130 - DNA, 23 bp, Artificial Sequence
  Synthetic construct
acgggggtccctcggtcagctac

SEQ ID NO: 11131 - DNA, 23 bp, Artificial Sequence
  Synthetic construct
cgggggtccctcggtcagctacc

SEQ ID NO: 11132 - DNA, 23 bp, Artificial Sequence
  Synthetic construct
gggggtccctcggtcagctaccg

SEQ ID NO: 11133 - DNA, 23 bp, Artificial Sequence
  Synthetic construct
ggggtccctcggtcagctaccga

SEQ ID NO: 11134 - DNA, 23 bp, Artificial Sequence
  Synthetic construct
gggtccctcggtcagctaccgag

SEQ ID NO: 11135 - DNA, 23 bp, Artificial Sequence
  Synthetic construct
ggtccctcggtcagctaccgagg

SEQ ID NO: 11136 - DNA, 23 bp, Artificial Sequence
  Synthetic construct
gtccctcggtcagctaccgagga

SEQ ID NO: 11137 - DNA, 23 bp, Artificial Sequence
  Synthetic construct
tccctcggtcagctaccgaggag

SEQ ID NO: 11138 - DNA, 23 bp, Artificial Sequence
  Synthetic construct
ccctcggtcagctaccgaggaga

SEQ ID NO: 11139 - DNA, 23 bp, Artificial Sequence
  Synthetic construct
cctcggtcagctaccgaggagag

SEQ ID NO: 11140 - DNA, 23 bp, Artificial Sequence
  Synthetic construct
ctcggtcagctaccgaggagagc

SEQ ID NO: 11141 - DNA, 23 bp, Artificial Sequence
  Synthetic construct
tcggtcagctaccgaggagagct

SEQ ID NO: 11142 - DNA, 23 bp, Artificial Sequence
  Synthetic construct
cggtcagctaccgaggagagctc

SEQ ID NO: 11143 - DNA, 23 bp, Artificial Sequence
  Synthetic construct
ggtcagctaccgaggagagctcg

SEQ ID NO: 11144 - DNA, 23 bp, Artificial Sequence
  Synthetic construct
gtcagctaccgaggagagctcgc

SEQ ID NO: 11145 - DNA, 23 bp, Artificial Sequence
  Synthetic construct
tcagctaccgaggagagctcgct

SEQ ID NO: 11146 - DNA, 23 bp, Artificial Sequence
  Synthetic construct
cagctaccgaggagagctcgctg

SEQ ID NO: 11147 - DNA, 23 bp, Artificial Sequence
  Synthetic construct
agctaccgaggagagctcgctgg

SEQ ID NO: 11148 - DNA, 23 bp, Artificial Sequence
  Synthetic construct
gctaccgaggagagctcgctggc

SEQ ID NO: 11149 - DNA, 23 bp, Artificial Sequence
  Synthetic construct
ctaccgaggagagctcgctggcc

SEQ ID NO: 11150 - DNA, 23 bp, Artificial Sequence
  Synthetic construct
taccgaggagagctcgctggccc

SEQ ID NO: 11151 - DNA, 23 bp, Artificial Sequence
  Synthetic construct
accgaggagagctcgctggccca

SEQ ID NO: 11152 - DNA, 23 bp, Artificial Sequence
  Synthetic construct
ccgaggagagctcgctggcccac

SEQ ID NO: 11153 - DNA, 23 bp, Artificial Sequence
  Synthetic construct
cgaggagagctcgctggcccaca

SEQ ID NO: 11154 - DNA, 23 bp, Artificial Sequence
  Synthetic construct
gaggagagctcgctggcccacac

SEQ ID NO: 11155 - DNA, 23 bp, Artificial Sequence
  Synthetic construct
aggagagctcgctggcccacact

SEQ ID NO: 11156 - DNA, 23 bp, Artificial Sequence
  Synthetic construct
ggagagctcgctggcccacactc

SEQ ID NO: 11157 - DNA, 23 bp, Artificial Sequence
  Synthetic construct
gagagctcgctggcccacactcc

SEQ ID NO: 11158 - DNA, 23 bp, Artificial Sequence
  Synthetic construct
agagctcgctggcccacactcct

SEQ ID NO: 11159 - DNA, 23 bp, Artificial Sequence
  Synthetic construct
gagctcgctggcccacactcctg

SEQ ID NO: 11160 - DNA, 23 bp, Artificial Sequence
  Synthetic construct
agctcgctggcccacactcctga

SEQ ID NO: 11161 - DNA, 23 bp, Artificial Sequence
  Synthetic construct
gctcgctggcccacactcctgag

SEQ ID NO: 11162 - DNA, 23 bp, Artificial Sequence
  Synthetic construct
ctcgctggcccacactcctgagg

SEQ ID NO: 11163 - DNA, 23 bp, Artificial Sequence
  Synthetic construct
tcgctggcccacactcctgaggg

SEQ ID NO: 11164 - DNA, 23 bp, Artificial Sequence
  Synthetic construct
cgctggcccacactcctgaggga

SEQ ID NO: 11165 - DNA, 23 bp, Artificial Sequence
  Synthetic construct
gctggcccacactcctgagggaa

SEQ ID NO: 11166 - DNA, 23 bp, Artificial Sequence
  Synthetic construct
ctggcccacactcctgagggaat

SEQ ID NO: 11167 - DNA, 23 bp, Artificial Sequence
  Synthetic construct
tggcccacactcctgagggaatg

SEQ ID NO: 11168 - DNA, 23 bp, Artificial Sequence
  Synthetic construct
ggcccacactcctgagggaatgt

SEQ ID NO: 11169 - DNA, 23 bp, Artificial Sequence
  Synthetic construct
gcccacactcctgagggaatgtg

SEQ ID NO: 11170 - DNA, 23 bp, Artificial Sequence
  Synthetic construct
cccacactcctgagggaatgtgg

SEQ ID NO: 11171 - DNA, 23 bp, Artificial Sequence
  Synthetic construct
ccacactcctgagggaatgtggg

SEQ ID NO: 11172 - DNA, 23 bp, Artificial Sequence
  Synthetic construct
cacactcctgagggaatgtggga

SEQ ID NO: 11173 - DNA, 23 bp, Artificial Sequence
  Synthetic construct
acactcctgagggaatgtgggaa

SEQ ID NO: 11174 - DNA, 23 bp, Artificial Sequence
  Synthetic construct
cactcctgagggaatgtgggaac

SEQ ID NO: 11175 - DNA, 23 bp, Artificial Sequence
  Synthetic construct
actcctgagggaatgtgggaacc

SEQ ID NO: 11176 - DNA, 23 bp, Artificial Sequence
  Synthetic construct
ctcctgagggaatgtgggaaccg

SEQ ID NO: 11177 - DNA, 23 bp, Artificial Sequence
  Synthetic construct
tcctgagggaatgtgggaaccgg

SEQ ID NO: 11178 - DNA, 23 bp, Artificial Sequence
  Synthetic construct
cctgagggaatgtgggaaccggc

SEQ ID NO: 11179 - DNA, 23 bp, Artificial Sequence
  Synthetic construct
ctgagggaatgtgggaaccggcg

SEQ ID NO: 11180 - DNA, 23 bp, Artificial Sequence
  Synthetic construct
tgagggaatgtgggaaccggcgt

SEQ ID NO: 11181 - DNA, 23 bp, Artificial Sequence
  Synthetic construct
gagggaatgtgggaaccggcgtt

SEQ ID NO: 11182 - DNA, 23 bp, Artificial Sequence
  Synthetic construct
agggaatgtgggaaccggcgtta

SEQ ID NO: 11183 - DNA, 23 bp, Artificial Sequence
  Synthetic construct
gggaatgtgggaaccggcgttag

SEQ ID NO: 11184 - DNA, 23 bp, Artificial Sequence
  Synthetic construct
ggaatgtgggaaccggcgttagc

SEQ ID NO: 11185 - DNA, 23 bp, Artificial Sequence
  Synthetic construct
gaatgtgggaaccggcgttagcc

SEQ ID NO: 11186 - DNA, 23 bp, Artificial Sequence
  Synthetic construct
aatgtgggaaccggcgttagcca

SEQ ID NO: 11187 - DNA, 23 bp, Artificial Sequence
  Synthetic construct
atgtgggaaccggcgttagccac

SEQ ID NO: 11188 - DNA, 23 bp, Artificial Sequence
  Synthetic construct
tgtgggaaccggcgttagccact

SEQ ID NO: 11189 - DNA, 23 bp, Artificial Sequence
  Synthetic construct
gtgggaaccggcgttagccactc

SEQ ID NO: 11190 - DNA, 23 bp, Artificial Sequence
  Synthetic construct
tgggaaccggcgttagccactcc

SEQ ID NO: 11191 - DNA, 23 bp, Artificial Sequence
  Synthetic construct
gggaaccggcgttagccactccg

SEQ ID NO: 11192 - DNA, 23 bp, Artificial Sequence
  Synthetic construct
ggaaccggcgttagccactccga

SEQ ID NO: 11193 - DNA, 23 bp, Artificial Sequence
  Synthetic construct
gaaccggcgttagccactccgaa

SEQ ID NO: 11194 - DNA, 23 bp, Artificial Sequence
  Synthetic construct
aaccggcgttagccactccgaag

SEQ ID NO: 11195 - DNA, 23 bp, Artificial Sequence
  Synthetic construct
accggcgttagccactccgaagt

SEQ ID NO: 11196 - DNA, 23 bp, Artificial Sequence
  Synthetic construct
ccggcgttagccactccgaagtg

SEQ ID NO: 11197 - DNA, 23 bp, Artificial Sequence
  Synthetic construct
cggcgttagccactccgaagtgc

SEQ ID NO: 11198 - DNA, 23 bp, Artificial Sequence
  Synthetic construct
ggcgttagccactccgaagtgcg

SEQ ID NO: 11199 - DNA, 23 bp, Artificial Sequence
  Synthetic construct
gcgttagccactccgaagtgcgt

SEQ ID NO: 11200 - DNA, 23 bp, Artificial Sequence
  Synthetic construct
cgttagccactccgaagtgcgta

SEQ ID NO: 11201 - DNA, 23 bp, Artificial Sequence
  Synthetic construct
gttagccactccgaagtgcgtat

SEQ ID NO: 11202 - DNA, 23 bp, Artificial Sequence
  Synthetic construct
ttagccactccgaagtgcgtata

SEQ ID NO: 11203 - DNA, 23 bp, Artificial Sequence
  Synthetic construct
tagccactccgaagtgcgtataa

SEQ ID NO: 11204 - DNA, 23 bp, Artificial Sequence
  Synthetic construct
agccactccgaagtgcgtataac

SEQ ID NO: 11205 - DNA, 23 bp, Artificial Sequence
  Synthetic construct
gccactccgaagtgcgtataacg

SEQ ID NO: 11206 - DNA, 23 bp, Artificial Sequence
  Synthetic construct
ccactccgaagtgcgtataacgc

SEQ ID NO: 11207 - DNA, 23 bp, Artificial Sequence
  Synthetic construct
cactccgaagtgcgtataacgcg

SEQ ID NO: 11208 - DNA, 23 bp, Artificial Sequence
  Synthetic construct
actccgaagtgcgtataacgcgc

SEQ ID NO: 11209 - DNA, 23 bp, Artificial Sequence
  Synthetic construct
ctccgaagtgcgtataacgcgca

SEQ ID NO: 11210 - DNA, 23 bp, Artificial Sequence
  Synthetic construct
tccgaagtgcgtataacgcgcac

SEQ ID NO: 11211 - DNA, 23 bp, Artificial Sequence
  Synthetic construct
ccgaagtgcgtataacgcgcacg

SEQ ID NO: 11212 - DNA, 23 bp, Artificial Sequence
  Synthetic construct
cgaagtgcgtataacgcgcacgc

SEQ ID NO: 11213 - DNA, 23 bp, Artificial Sequence
  Synthetic construct
gaagtgcgtataacgcgcacgcc

SEQ ID NO: 11214 - DNA, 23 bp, Artificial Sequence
  Synthetic construct
aagtgcgtataacgcgcacgccg

SEQ ID NO: 11215 - DNA, 23 bp, Artificial Sequence
  Synthetic construct
agtgcgtataacgcgcacgccgg

SEQ ID NO: 11216 - DNA, 23 bp, Artificial Sequence
  Synthetic construct
gtgcgtataacgcgcacgccggc

SEQ ID NO: 11217 - DNA, 23 bp, Artificial Sequence
  Synthetic construct
tgcgtataacgcgcacgccggcg

SEQ ID NO: 11218 - DNA, 23 bp, Artificial Sequence
  Synthetic construct
gcgtataacgcgcacgccggcgg

SEQ ID NO: 11219 - DNA, 23 bp, Artificial Sequence
  Synthetic construct
cgtataacgcgcacgccggcgga

SEQ ID NO: 11220 - DNA, 23 bp, Artificial Sequence
  Synthetic construct
gtataacgcgcacgccggcggac

SEQ ID NO: 11221 - DNA, 23 bp, Artificial Sequence
  Synthetic construct
tataacgcgcacgccggcggact

SEQ ID NO: 11222 - DNA, 23 bp, Artificial Sequence
  Synthetic construct
ataacgcgcacgccggcggactt

SEQ ID NO: 11223 - DNA, 23 bp, Artificial Sequence
  Synthetic construct
taacgcgcacgccggcggacttc

SEQ ID NO: 11224 - DNA, 23 bp, Artificial Sequence
  Synthetic construct
aacgcgcacgccggcggacttca

SEQ ID NO: 11225 - DNA, 23 bp, Artificial Sequence
  Synthetic construct
acgcgcacgccggcggacttcat

SEQ ID NO: 11226 - DNA, 23 bp, Artificial Sequence
  Synthetic construct
cgcgcacgccggcggacttcatg

SEQ ID NO: 11227 - DNA, 23 bp, Artificial Sequence
  Synthetic construct
gcgcacgccggcggacttcatgc

SEQ ID NO: 11228 - DNA, 23 bp, Artificial Sequence
  Synthetic construct
cgcacgccggcggacttcatgct

SEQ ID NO: 11229 - DNA, 23 bp, Artificial Sequence
  Synthetic construct
gcacgccggcggacttcatgctg

SEQ ID NO: 11230 - DNA, 23 bp, Artificial Sequence
  Synthetic construct
cacgccggcggacttcatgctgt

SEQ ID NO: 11231 - DNA, 23 bp, Artificial Sequence
  Synthetic construct
acgccggcggacttcatgctgtc

SEQ ID NO: 11232 - DNA, 23 bp, Artificial Sequence
  Synthetic construct
cgccggcggacttcatgctgtcg

SEQ ID NO: 11233 - DNA, 23 bp, Artificial Sequence
  Synthetic construct
gccggcggacttcatgctgtcgg

SEQ ID NO: 11234 - DNA, 23 bp, Artificial Sequence
  Synthetic construct
ccggcggacttcatgctgtcggt

SEQ ID NO: 11235 - DNA, 23 bp, Artificial Sequence
  Synthetic construct
cggcggacttcatgctgtcggtg

SEQ ID NO: 11236 - DNA, 23 bp, Artificial Sequence
  Synthetic construct
ggcggacttcatgctgtcggtga

SEQ ID NO: 11237 - DNA, 23 bp, Artificial Sequence
  Synthetic construct
gcggacttcatgctgtcggtgat

SEQ ID NO: 11238 - DNA, 23 bp, Artificial Sequence
  Synthetic construct
cggacttcatgctgtcggtgatt

SEQ ID NO: 11239 - DNA, 23 bp, Artificial Sequence
  Synthetic construct
ggacttcatgctgtcggtgattt

SEQ ID NO: 11240 - DNA, 23 bp, Artificial Sequence
  Synthetic construct
gacttcatgctgtcggtgatttc

SEQ ID NO: 11241 - DNA, 23 bp, Artificial Sequence
  Synthetic construct
acttcatgctgtcggtgatttca

SEQ ID NO: 11242 - DNA, 23 bp, Artificial Sequence
  Synthetic construct
cttcatgctgtcggtgatttcac

SEQ ID NO: 11243 - DNA, 23 bp, Artificial Sequence
  Synthetic construct
ttcatgctgtcggtgatttcacc

SEQ ID NO: 11244 - DNA, 23 bp, Artificial Sequence
  Synthetic construct
tcatgctgtcggtgatttcacct

SEQ ID NO: 11245 - DNA, 23 bp, Artificial Sequence
  Synthetic construct
catgctgtcggtgatttcacctc

SEQ ID NO: 11246 - DNA, 23 bp, Artificial Sequence
  Synthetic construct
atgctgtcggtgatttcacctcc

SEQ ID NO: 11247 - DNA, 23 bp, Artificial Sequence
  Synthetic construct
tgctgtcggtgatttcacctcca

SEQ ID NO: 11248 - DNA, 23 bp, Artificial Sequence
  Synthetic construct
gctgtcggtgatttcacctccag

SEQ ID NO: 11249 - DNA, 23 bp, Artificial Sequence
  Synthetic construct
ctgtcggtgatttcacctccagt

SEQ ID NO: 11250 - DNA, 23 bp, Artificial Sequence
  Synthetic construct
tgtcggtgatttcacctccagta

SEQ ID NO: 11251 - DNA, 23 bp, Artificial Sequence
  Synthetic construct
gtcggtgatttcacctccagtat

SEQ ID NO: 11252 - DNA, 23 bp, Artificial Sequence
  Synthetic construct
tcggtgatttcacctccagtatg

SEQ ID NO: 11253 - DNA, 23 bp, Artificial Sequence
  Synthetic construct
cggtgatttcacctccagtatgg

SEQ ID NO: 11254 - DNA, 23 bp, Artificial Sequence
  Synthetic construct
ggtgatttcacctccagtatgga

SEQ ID NO: 11255 - DNA, 23 bp, Artificial Sequence
  Synthetic construct
gtgatttcacctccagtatggaa

SEQ ID NO: 11256 - DNA, 23 bp, Artificial Sequence
  Synthetic construct
tgatttcacctccagtatggaac

SEQ ID NO: 11257 - DNA, 23 bp, Artificial Sequence
  Synthetic construct
gatttcacctccagtatggaacc

SEQ ID NO: 11258 - DNA, 23 bp, Artificial Sequence
  Synthetic construct
atttcacctccagtatggaacca

SEQ ID NO: 11259 - DNA, 23 bp, Artificial Sequence
  Synthetic construct
tttcacctccagtatggaaccac

SEQ ID NO: 11260 - DNA, 23 bp, Artificial Sequence
  Synthetic construct
ttcacctccagtatggaaccacg

SEQ ID NO: 11261 - DNA, 23 bp, Artificial Sequence
  Synthetic construct
tcacctccagtatggaaccacgc

SEQ ID NO: 11262 - DNA, 23 bp, Artificial Sequence
  Synthetic construct
cacctccagtatggaaccacgct

SEQ ID NO: 11263 - DNA, 23 bp, Artificial Sequence
  Synthetic construct
acctccagtatggaaccacgcta

SEQ ID NO: 11264 - DNA, 23 bp, Artificial Sequence
  Synthetic construct
cctccagtatggaaccacgctat

SEQ ID NO: 11265 - DNA, 23 bp, Artificial Sequence
  Synthetic construct
ctccagtatggaaccacgctatg

SEQ ID NO: 11266 - DNA, 23 bp, Artificial Sequence
  Synthetic construct
tccagtatggaaccacgctatgt

SEQ ID NO: 11267 - DNA, 23 bp, Artificial Sequence
  Synthetic construct
ccagtatggaaccacgctatgta

SEQ ID NO: 11268 - DNA, 23 bp, Artificial Sequence
  Synthetic construct
cagtatggaaccacgctatgtag

SEQ ID NO: 11269 - DNA, 23 bp, Artificial Sequence
  Synthetic construct
agtatggaaccacgctatgtagc

SEQ ID NO: 11270 - DNA, 23 bp, Artificial Sequence
  Synthetic construct
gtatggaaccacgctatgtagcg

SEQ ID NO: 11271 - DNA, 23 bp, Artificial Sequence
  Synthetic construct
tatggaaccacgctatgtagcga

SEQ ID NO: 11272 - DNA, 23 bp, Artificial Sequence
  Synthetic construct
atggaaccacgctatgtagcgac

SEQ ID NO: 11273 - DNA, 23 bp, Artificial Sequence
  Synthetic construct
tggaaccacgctatgtagcgacc

SEQ ID NO: 11274 - DNA, 23 bp, Artificial Sequence
  Synthetic construct
ggaaccacgctatgtagcgacca

SEQ ID NO: 11275 - DNA, 23 bp, Artificial Sequence
  Synthetic construct
gaaccacgctatgtagcgaccac

SEQ ID NO: 11276 - DNA, 23 bp, Artificial Sequence
  Synthetic construct
aaccacgctatgtagcgaccact

SEQ ID NO: 11277 - DNA, 23 bp, Artificial Sequence
  Synthetic construct
accacgctatgtagcgaccactg

SEQ ID NO: 11278 - DNA, 23 bp, Artificial Sequence
  Synthetic construct
ccacgctatgtagcgaccactgt

SEQ ID NO: 11279 - DNA, 23 bp, Artificial Sequence
  Synthetic construct
cacgctatgtagcgaccactgtc

SEQ ID NO: 11280 - DNA, 23 bp, Artificial Sequence
  Synthetic construct
acgctatgtagcgaccactgtcg

SEQ ID NO: 11281 - DNA, 23 bp, Artificial Sequence
  Synthetic construct
cgctatgtagcgaccactgtcgt

SEQ ID NO: 11282 - DNA, 23 bp, Artificial Sequence
  Synthetic construct
gctatgtagcgaccactgtcgtg

SEQ ID NO: 11283 - DNA, 23 bp, Artificial Sequence
  Synthetic construct
ctatgtagcgaccactgtcgtgc

SEQ ID NO: 11284 - DNA, 23 bp, Artificial Sequence
  Synthetic construct
tatgtagcgaccactgtcgtgct

SEQ ID NO: 11285 - DNA, 23 bp, Artificial Sequence
  Synthetic construct
atgtagcgaccactgtcgtgctt

SEQ ID NO: 11286 - DNA, 23 bp, Artificial Sequence
  Synthetic construct
tgtagcgaccactgtcgtgcttt

SEQ ID NO: 11287 - DNA, 23 bp, Artificial Sequence
  Synthetic construct
gtagcgaccactgtcgtgctttt

SEQ ID NO: 11288 - DNA, 23 bp, Artificial Sequence
  Synthetic construct
tagcgaccactgtcgtgcttttc

SEQ ID NO: 11289 - DNA, 23 bp, Artificial Sequence
  Synthetic construct
agcgaccactgtcgtgcttttcg

SEQ ID NO: 11290 - DNA, 23 bp, Artificial Sequence
  Synthetic construct
gcgaccactgtcgtgcttttcgc

SEQ ID NO: 11291 - DNA, 23 bp, Artificial Sequence
  Synthetic construct
cgaccactgtcgtgcttttcgct

SEQ ID NO: 11292 - DNA, 23 bp, Artificial Sequence
  Synthetic construct
gaccactgtcgtgcttttcgctg

SEQ ID NO: 11293 - DNA, 23 bp, Artificial Sequence
  Synthetic construct
accactgtcgtgcttttcgctga

SEQ ID NO: 11294 - DNA, 23 bp, Artificial Sequence
  Synthetic construct
ccactgtcgtgcttttcgctgaa

SEQ ID NO: 11295 - DNA, 23 bp, Artificial Sequence
  Synthetic construct
cactgtcgtgcttttcgctgaag

SEQ ID NO: 11296 - DNA, 23 bp, Artificial Sequence
  Synthetic construct
actgtcgtgcttttcgctgaaga

SEQ ID NO: 11297 - DNA, 23 bp, Artificial Sequence
  Synthetic construct
ctgtcgtgcttttcgctgaagaa

SEQ ID NO: 11298 - DNA, 23 bp, Artificial Sequence
  Synthetic construct
tgtcgtgcttttcgctgaagaac

SEQ ID NO: 11299 - DNA, 23 bp, Artificial Sequence
  Synthetic construct
gtcgtgcttttcgctgaagaact

SEQ ID NO: 11300 - DNA, 23 bp, Artificial Sequence
  Synthetic construct
tcgtgcttttcgctgaagaactt

SEQ ID NO: 11301 - DNA, 23 bp, Artificial Sequence
  Synthetic construct
cgtgcttttcgctgaagaacttg

SEQ ID NO: 11302 - DNA, 23 bp, Artificial Sequence
  Synthetic construct
gtgcttttcgctgaagaacttgc

SEQ ID NO: 11303 - DNA, 23 bp, Artificial Sequence
  Synthetic construct
tgcttttcgctgaagaacttgcg

SEQ ID NO: 11304 - DNA, 23 bp, Artificial Sequence
  Synthetic construct
gcttttcgctgaagaacttgcgt

SEQ ID NO: 11305 - DNA, 23 bp, Artificial Sequence
  Synthetic construct
cttttcgctgaagaacttgcgtt

SEQ ID NO: 11306 - DNA, 23 bp, Artificial Sequence
  Synthetic construct
ttttcgctgaagaacttgcgttc

SEQ ID NO: 11307 - DNA, 23 bp, Artificial Sequence
  Synthetic construct
tttcgctgaagaacttgcgttct

SEQ ID NO: 11308 - DNA, 23 bp, Artificial Sequence
  Synthetic construct
ttcgctgaagaacttgcgttctc

SEQ ID NO: 11309 - DNA, 23 bp, Artificial Sequence
  Synthetic construct
tcgctgaagaacttgcgttctcg

SEQ ID NO: 11310 - DNA, 23 bp, Artificial Sequence
  Synthetic construct
cgctgaagaacttgcgttctcga

SEQ ID NO: 11311 - DNA, 23 bp, Artificial Sequence
  Synthetic construct
gctgaagaacttgcgttctcgag

SEQ ID NO: 11312 - DNA, 23 bp, Artificial Sequence
  Synthetic construct
ctgaagaacttgcgttctcgagc

SEQ ID NO: 11313 - DNA, 23 bp, Artificial Sequence
  Synthetic construct
tgaagaacttgcgttctcgagcg

SEQ ID NO: 11314 - DNA, 23 bp, Artificial Sequence
  Synthetic construct
gaagaacttgcgttctcgagcga

SEQ ID NO: 11315 - DNA, 23 bp, Artificial Sequence
  Synthetic construct
aagaacttgcgttctcgagcgat

SEQ ID NO: 11316 - DNA, 23 bp, Artificial Sequence
  Synthetic construct
agaacttgcgttctcgagcgata

SEQ ID NO: 11317 - DNA, 23 bp, Artificial Sequence
  Synthetic construct
gaacttgcgttctcgagcgatac

SEQ ID NO: 11318 - DNA, 23 bp, Artificial Sequence
  Synthetic construct
aacttgcgttctcgagcgatacg

SEQ ID NO: 11319 - DNA, 23 bp, Artificial Sequence
  Synthetic construct
acttgcgttctcgagcgatacga

SEQ ID NO: 11320 - DNA, 23 bp, Artificial Sequence
  Synthetic construct
cttgcgttctcgagcgatacgag

SEQ ID NO: 11321 - DNA, 23 bp, Artificial Sequence
  Synthetic construct
ttgcgttctcgagcgatacgagc

SEQ ID NO: 11322 - DNA, 23 bp, Artificial Sequence
  Synthetic construct
tgcgttctcgagcgatacgagca

SEQ ID NO: 11323 - DNA, 23 bp, Artificial Sequence
  Synthetic construct
gcgttctcgagcgatacgagcaa

SEQ ID NO: 11324 - DNA, 23 bp, Artificial Sequence
  Synthetic construct
cgttctcgagcgatacgagcaag

SEQ ID NO: 11325 - DNA, 23 bp, Artificial Sequence
  Synthetic construct
gttctcgagcgatacgagcaaga

SEQ ID NO: 11326 - DNA, 23 bp, Artificial Sequence
  Synthetic construct
ttctcgagcgatacgagcaagac

SEQ ID NO: 11327 - DNA, 23 bp, Artificial Sequence
  Synthetic construct
tctcgagcgatacgagcaagacg

SEQ ID NO: 11328 - DNA, 23 bp, Artificial Sequence
  Synthetic construct
ctcgagcgatacgagcaagacgg

SEQ ID NO: 11329 - DNA, 23 bp, Artificial Sequence
  Synthetic construct
tcgagcgatacgagcaagacgga

SEQ ID NO: 11330 - DNA, 23 bp, Artificial Sequence
  Synthetic construct
cgagcgatacgagcaagacggaa

SEQ ID NO: 11331 - DNA, 23 bp, Artificial Sequence
  Synthetic construct
gagcgatacgagcaagacggaaa

SEQ ID NO: 11332 - DNA, 23 bp, Artificial Sequence
  Synthetic construct
agcgatacgagcaagacggaaac

SEQ ID NO: 11333 - DNA, 23 bp, Artificial Sequence
  Synthetic construct
gcgatacgagcaagacggaaacc

SEQ ID NO: 11334 - DNA, 23 bp, Artificial Sequence
  Synthetic construct
cgatacgagcaagacggaaaccc

SEQ ID NO: 11335 - DNA, 23 bp, Artificial Sequence
  Synthetic construct
gatacgagcaagacggaaacccg

SEQ ID NO: 11336 - DNA, 23 bp, Artificial Sequence
  Synthetic construct
atacgagcaagacggaaacccga

SEQ ID NO: 11337 - DNA, 23 bp, Artificial Sequence
  Synthetic construct
tacgagcaagacggaaacccgag

SEQ ID NO: 11338 - DNA, 23 bp, Artificial Sequence
  Synthetic construct
acgagcaagacggaaacccgagg

SEQ ID NO: 11339 - DNA, 23 bp, Artificial Sequence
  Synthetic construct
cgagcaagacggaaacccgaggt

SEQ ID NO: 11340 - DNA, 23 bp, Artificial Sequence
  Synthetic construct
gagcaagacggaaacccgaggta

SEQ ID NO: 11341 - DNA, 23 bp, Artificial Sequence
  Synthetic construct
agcaagacggaaacccgaggtac

SEQ ID NO: 11342 - DNA, 23 bp, Artificial Sequence
  Synthetic construct
gcaagacggaaacccgaggtacg

SEQ ID NO: 11343 - DNA, 23 bp, Artificial Sequence
  Synthetic construct
caagacggaaacccgaggtacgg

SEQ ID NO: 11344 - DNA, 23 bp, Artificial Sequence
  Synthetic construct
aagacggaaacccgaggtacggg

SEQ ID NO: 11345 - DNA, 23 bp, Artificial Sequence
  Synthetic construct
agacggaaacccgaggtacgggt

SEQ ID NO: 11346 - DNA, 23 bp, Artificial Sequence
  Synthetic construct
gacggaaacccgaggtacgggta

SEQ ID NO: 11347 - DNA, 23 bp, Artificial Sequence
  Synthetic construct
acggaaacccgaggtacgggtat

SEQ ID NO: 11348 - DNA, 23 bp, Artificial Sequence
  Synthetic construct
cggaaacccgaggtacgggtatc

SEQ ID NO: 11349 - DNA, 23 bp, Artificial Sequence
  Synthetic construct
ggaaacccgaggtacgggtatcc

SEQ ID NO: 11350 - DNA, 23 bp, Artificial Sequence
  Synthetic construct
gaaacccgaggtacgggtatccg

SEQ ID NO: 11351 - DNA, 23 bp, Artificial Sequence
  Synthetic construct
aaacccgaggtacgggtatccgc

SEQ ID NO: 11352 - DNA, 23 bp, Artificial Sequence
  Synthetic construct
aacccgaggtacgggtatccgcg

SEQ ID NO: 11353 - DNA, 23 bp, Artificial Sequence
  Synthetic construct
acccgaggtacgggtatccgcga

SEQ ID NO: 11354 - DNA, 23 bp, Artificial Sequence
  Synthetic construct
cccgaggtacgggtatccgcgag

SEQ ID NO: 11355 - DNA, 23 bp, Artificial Sequence
  Synthetic construct
ccgaggtacgggtatccgcgagc

SEQ ID NO: 11356 - DNA, 23 bp, Artificial Sequence
  Synthetic construct
cgaggtacgggtatccgcgagca

SEQ ID NO: 11357 - DNA, 23 bp, Artificial Sequence
  Synthetic construct
gaggtacgggtatccgcgagcag

SEQ ID NO: 11358 - DNA, 23 bp, Artificial Sequence
  Synthetic construct
aggtacgggtatccgcgagcagc

SEQ ID NO: 11359 - DNA, 23 bp, Artificial Sequence
  Synthetic construct
ggtacgggtatccgcgagcagcc

SEQ ID NO: 11360 - DNA, 23 bp, Artificial Sequence
  Synthetic construct
gtacgggtatccgcgagcagccg

SEQ ID NO: 11361 - DNA, 23 bp, Artificial Sequence
  Synthetic construct
tacgggtatccgcgagcagccgc

SEQ ID NO: 11362 - DNA, 23 bp, Artificial Sequence
  Synthetic construct
acgggtatccgcgagcagccgcc

SEQ ID NO: 11363 - DNA, 23 bp, Artificial Sequence
  Synthetic construct
cgggtatccgcgagcagccgccc

SEQ ID NO: 11364 - DNA, 23 bp, Artificial Sequence
  Synthetic construct
gggtatccgcgagcagccgcccg

SEQ ID NO: 11365 - DNA, 23 bp, Artificial Sequence
  Synthetic construct
ggtatccgcgagcagccgcccgt

SEQ ID NO: 11366 - DNA, 23 bp, Artificial Sequence
  Synthetic construct
gtatccgcgagcagccgcccgta

SEQ ID NO: 11367 - DNA, 23 bp, Artificial Sequence
  Synthetic construct
tatccgcgagcagccgcccgtac

SEQ ID NO: 11368 - DNA, 23 bp, Artificial Sequence
  Synthetic construct
atccgcgagcagccgcccgtacg

SEQ ID NO: 11369 - DNA, 23 bp, Artificial Sequence
  Synthetic construct
tccgcgagcagccgcccgtacgg

SEQ ID NO: 11370 - DNA, 23 bp, Artificial Sequence
  Synthetic construct
ccgcgagcagccgcccgtacgga

SEQ ID NO: 11371 - DNA, 23 bp, Artificial Sequence
  Synthetic construct
cgcgagcagccgcccgtacggag

SEQ ID NO: 11372 - DNA, 23 bp, Artificial Sequence
  Synthetic construct
gcgagcagccgcccgtacggagt

SEQ ID NO: 11373 - DNA, 23 bp, Artificial Sequence
  Synthetic construct
cgagcagccgcccgtacggagtc

SEQ ID NO: 11374 - DNA, 23 bp, Artificial Sequence
  Synthetic construct
gagcagccgcccgtacggagtct

SEQ ID NO: 11375 - DNA, 23 bp, Artificial Sequence
  Synthetic construct
agcagccgcccgtacggagtctt

SEQ ID NO: 11376 - DNA, 23 bp, Artificial Sequence
  Synthetic construct
gcagccgcccgtacggagtcttg

SEQ ID NO: 11377 - DNA, 23 bp, Artificial Sequence
  Synthetic construct
cagccgcccgtacggagtcttgg

SEQ ID NO: 11378 - DNA, 23 bp, Artificial Sequence
  Synthetic construct
agccgcccgtacggagtcttggt

SEQ ID NO: 11379 - DNA, 23 bp, Artificial Sequence
  Synthetic construct
gccgcccgtacggagtcttggtg

SEQ ID NO: 11380 - DNA, 23 bp, Artificial Sequence
  Synthetic construct
ccgcccgtacggagtcttggtgt

SEQ ID NO: 11381 - DNA, 23 bp, Artificial Sequence
  Synthetic construct
cgcccgtacggagtcttggtgta

SEQ ID NO: 11382 - DNA, 23 bp, Artificial Sequence
  Synthetic construct
gcccgtacggagtcttggtgtat

SEQ ID NO: 11383 - DNA, 23 bp, Artificial Sequence
  Synthetic construct
cccgtacggagtcttggtgtata

SEQ ID NO: 11384 - DNA, 23 bp, Artificial Sequence
  Synthetic construct
ccgtacggagtcttggtgtatac

SEQ ID NO: 11385 - DNA, 23 bp, Artificial Sequence
  Synthetic construct
cgtacggagtcttggtgtatacc

SEQ ID NO: 11386 - DNA, 23 bp, Artificial Sequence
  Synthetic construct
gtacggagtcttggtgtataccg

SEQ ID NO: 11387 - DNA, 23 bp, Artificial Sequence
  Synthetic construct
tacggagtcttggtgtataccga

SEQ ID NO: 11388 - DNA, 23 bp, Artificial Sequence
  Synthetic construct
acggagtcttggtgtataccgag

SEQ ID NO: 11389 - DNA, 23 bp, Artificial Sequence
  Synthetic construct
cggagtcttggtgtataccgaga

SEQ ID NO: 11390 - DNA, 23 bp, Artificial Sequence
  Synthetic construct
ggagtcttggtgtataccgagac

SEQ ID NO: 11391 - DNA, 23 bp, Artificial Sequence
  Synthetic construct
gagtcttggtgtataccgagact

SEQ ID NO: 11392 - DNA, 23 bp, Artificial Sequence
  Synthetic construct
agtcttggtgtataccgagactg

SEQ ID NO: 11393 - DNA, 23 bp, Artificial Sequence
  Synthetic construct
gtcttggtgtataccgagactgc

SEQ ID NO: 11394 - DNA, 23 bp, Artificial Sequence
  Synthetic construct
tcttggtgtataccgagactgcc

SEQ ID NO: 11395 - DNA, 23 bp, Artificial Sequence
  Synthetic construct
cttggtgtataccgagactgccg

SEQ ID NO: 11396 - DNA, 23 bp, Artificial Sequence
  Synthetic construct
ttggtgtataccgagactgccgt

SEQ ID NO: 11397 - DNA, 23 bp, Artificial Sequence
  Synthetic construct
tggtgtataccgagactgccgta

SEQ ID NO: 11398 - DNA, 23 bp, Artificial Sequence
  Synthetic construct
ggtgtataccgagactgccgtag

SEQ ID NO: 11399 - DNA, 23 bp, Artificial Sequence
  Synthetic construct
gtgtataccgagactgccgtagg

SEQ ID NO: 11400 - DNA, 23 bp, Artificial Sequence
  Synthetic construct
tgtataccgagactgccgtaggc

SEQ ID NO: 11401 - DNA, 23 bp, Artificial Sequence
  Synthetic construct
gtataccgagactgccgtaggcg

SEQ ID NO: 11402 - DNA, 23 bp, Artificial Sequence
  Synthetic construct
tataccgagactgccgtaggcgg

SEQ ID NO: 11403 - DNA, 23 bp, Artificial Sequence
  Synthetic construct
ataccgagactgccgtaggcggg

SEQ ID NO: 11404 - DNA, 23 bp, Artificial Sequence
  Synthetic construct
taccgagactgccgtaggcgggc

SEQ ID NO: 11405 - DNA, 23 bp, Artificial Sequence
  Synthetic construct
accgagactgccgtaggcgggct

SEQ ID NO: 11406 - DNA, 23 bp, Artificial Sequence
  Synthetic construct
ccgagactgccgtaggcgggctg

SEQ ID NO: 11407 - DNA, 23 bp, Artificial Sequence
  Synthetic construct
cgagactgccgtaggcgggctga

SEQ ID NO: 11408 - DNA, 23 bp, Artificial Sequence
  Synthetic construct
gagactgccgtaggcgggctgac

SEQ ID NO: 11409 - DNA, 23 bp, Artificial Sequence
  Synthetic construct
agactgccgtaggcgggctgact

SEQ ID NO: 11410 - DNA, 23 bp, Artificial Sequence
  Synthetic construct
gactgccgtaggcgggctgacta

SEQ ID NO: 11411 - DNA, 23 bp, Artificial Sequence
  Synthetic construct
actgccgtaggcgggctgactac

SEQ ID NO: 11412 - DNA, 23 bp, Artificial Sequence
  Synthetic construct
ctgccgtaggcgggctgactacg

SEQ ID NO: 11413 - DNA, 23 bp, Artificial Sequence
  Synthetic construct
tgccgtaggcgggctgactacgt

SEQ ID NO: 11414 - DNA, 23 bp, Artificial Sequence
  Synthetic construct
gccgtaggcgggctgactacgta

SEQ ID NO: 11415 - DNA, 23 bp, Artificial Sequence
  Synthetic construct
ccgtaggcgggctgactacgtag

SEQ ID NO: 11416 - DNA, 23 bp, Artificial Sequence
  Synthetic construct
cgtaggcgggctgactacgtagt

SEQ ID NO: 11417 - DNA, 23 bp, Artificial Sequence
  Synthetic construct
gtaggcgggctgactacgtagta

SEQ ID NO: 11418 - DNA, 23 bp, Artificial Sequence
  Synthetic construct
taggcgggctgactacgtagtag

SEQ ID NO: 11419 - DNA, 23 bp, Artificial Sequence
  Synthetic construct
aggcgggctgactacgtagtagt

SEQ ID NO: 11420 - DNA, 23 bp, Artificial Sequence
  Synthetic construct
ggcgggctgactacgtagtagtc

SEQ ID NO: 11421 - DNA, 23 bp, Artificial Sequence
  Synthetic construct
gcgggctgactacgtagtagtcg

SEQ ID NO: 11422 - DNA, 23 bp, Artificial Sequence
  Synthetic construct
cgggctgactacgtagtagtcgg

SEQ ID NO: 11423 - DNA, 23 bp, Artificial Sequence
  Synthetic construct
gggctgactacgtagtagtcggc

SEQ ID NO: 11424 - DNA, 23 bp, Artificial Sequence
  Synthetic construct
ggctgactacgtagtagtcggca

SEQ ID NO: 11425 - DNA, 23 bp, Artificial Sequence
  Synthetic construct
gctgactacgtagtagtcggcag

SEQ ID NO: 11426 - DNA, 23 bp, Artificial Sequence
  Synthetic construct
ctgactacgtagtagtcggcagc

SEQ ID NO: 11427 - DNA, 23 bp, Artificial Sequence
  Synthetic construct
tgactacgtagtagtcggcagcg

SEQ ID NO: 11428 - DNA, 23 bp, Artificial Sequence
  Synthetic construct
gactacgtagtagtcggcagcga

SEQ ID NO: 11429 - DNA, 23 bp, Artificial Sequence
  Synthetic construct
actacgtagtagtcggcagcgag

SEQ ID NO: 11430 - DNA, 23 bp, Artificial Sequence
  Synthetic construct
ctacgtagtagtcggcagcgagg

SEQ ID NO: 11431 - DNA, 23 bp, Artificial Sequence
  Synthetic construct
tacgtagtagtcggcagcgaggt

SEQ ID NO: 11432 - DNA, 23 bp, Artificial Sequence
  Synthetic construct
acgtagtagtcggcagcgaggtc

SEQ ID NO: 11433 - DNA, 23 bp, Artificial Sequence
  Synthetic construct
cgtagtagtcggcagcgaggtcc

SEQ ID NO: 11434 - DNA, 23 bp, Artificial Sequence
  Synthetic construct
gtagtagtcggcagcgaggtccg

SEQ ID NO: 11435 - DNA, 23 bp, Artificial Sequence
  Synthetic construct
tagtagtcggcagcgaggtccgt

SEQ ID NO: 11436 - DNA, 23 bp, Artificial Sequence
  Synthetic construct
agtagtcggcagcgaggtccgtc

SEQ ID NO: 11437 - DNA, 23 bp, Artificial Sequence
  Synthetic construct
gtagtcggcagcgaggtccgtcc

SEQ ID NO: 11438 - DNA, 23 bp, Artificial Sequence
  Synthetic construct
tagtcggcagcgaggtccgtccc

SEQ ID NO: 11439 - DNA, 23 bp, Artificial Sequence
  Synthetic construct
agtcggcagcgaggtccgtccca

SEQ ID NO: 11440 - DNA, 23 bp, Artificial Sequence
  Synthetic construct
gtcggcagcgaggtccgtcccac

SEQ ID NO: 11441 - DNA, 23 bp, Artificial Sequence
  Synthetic construct
tcggcagcgaggtccgtcccacc

SEQ ID NO: 11442 - DNA, 23 bp, Artificial Sequence
  Synthetic construct
cggcagcgaggtccgtcccaccg

SEQ ID NO: 11443 - DNA, 23 bp, Artificial Sequence
  Synthetic construct
ggcagcgaggtccgtcccaccga

SEQ ID NO: 11444 - DNA, 23 bp, Artificial Sequence
  Synthetic construct
gcagcgaggtccgtcccaccgaa

SEQ ID NO: 11445 - DNA, 23 bp, Artificial Sequence
  Synthetic construct
cagcgaggtccgtcccaccgaag

SEQ ID NO: 11446 - DNA, 23 bp, Artificial Sequence
  Synthetic construct
agcgaggtccgtcccaccgaaga

SEQ ID NO: 11447 - DNA, 23 bp, Artificial Sequence
  Synthetic construct
gcgaggtccgtcccaccgaagaa

SEQ ID NO: 11448 - DNA, 23 bp, Artificial Sequence
  Synthetic construct
cgaggtccgtcccaccgaagaac

SEQ ID NO: 11449 - DNA, 23 bp, Artificial Sequence
  Synthetic construct
gaggtccgtcccaccgaagaaca

SEQ ID NO: 11450 - DNA, 23 bp, Artificial Sequence
  Synthetic construct
aggtccgtcccaccgaagaacat

SEQ ID NO: 11451 - DNA, 23 bp, Artificial Sequence
  Synthetic construct
ggtccgtcccaccgaagaacatc

SEQ ID NO: 11452 - DNA, 23 bp, Artificial Sequence
  Synthetic construct
gtccgtcccaccgaagaacatcg

SEQ ID NO: 11453 - DNA, 23 bp, Artificial Sequence
  Synthetic construct
tccgtcccaccgaagaacatcga

SEQ ID NO: 11454 - DNA, 23 bp, Artificial Sequence
  Synthetic construct
ccgtcccaccgaagaacatcgaa

SEQ ID NO: 11455 - DNA, 23 bp, Artificial Sequence
  Synthetic construct
cgtcccaccgaagaacatcgaag

SEQ ID NO: 11456 - DNA, 23 bp, Artificial Sequence
  Synthetic construct
gtcccaccgaagaacatcgaagg

SEQ ID NO: 11457 - DNA, 23 bp, Artificial Sequence
  Synthetic construct
tcccaccgaagaacatcgaaggc

SEQ ID NO: 11458 - DNA, 23 bp, Artificial Sequence
  Synthetic construct
cccaccgaagaacatcgaaggca

SEQ ID NO: 11459 - DNA, 23 bp, Artificial Sequence
  Synthetic construct
ccaccgaagaacatcgaaggcac

SEQ ID NO: 11460 - DNA, 23 bp, Artificial Sequence
  Synthetic construct
caccgaagaacatcgaaggcacc

SEQ ID NO: 11461 - DNA, 23 bp, Artificial Sequence
  Synthetic construct
accgaagaacatcgaaggcacct

SEQ ID NO: 11462 - DNA, 23 bp, Artificial Sequence
  Synthetic construct
ccgaagaacatcgaaggcacctg

SEQ ID NO: 11463 - DNA, 23 bp, Artificial Sequence
  Synthetic construct
cgaagaacatcgaaggcacctgg

SEQ ID NO: 11464 - DNA, 23 bp, Artificial Sequence
  Synthetic construct
gaagaacatcgaaggcacctggg

SEQ ID NO: 11465 - DNA, 23 bp, Artificial Sequence
  Synthetic construct
aagaacatcgaaggcacctggga

SEQ ID NO: 11466 - DNA, 23 bp, Artificial Sequence
  Synthetic construct
agaacatcgaaggcacctgggag

SEQ ID NO: 11467 - DNA, 23 bp, Artificial Sequence
  Synthetic construct
gaacatcgaaggcacctgggagg

SEQ ID NO: 11468 - DNA, 23 bp, Artificial Sequence
  Synthetic construct
aacatcgaaggcacctgggagga

SEQ ID NO: 11469 - DNA, 23 bp, Artificial Sequence
  Synthetic construct
acatcgaaggcacctgggaggag

SEQ ID NO: 11470 - DNA, 23 bp, Artificial Sequence
  Synthetic construct
catcgaaggcacctgggaggaga

SEQ ID NO: 11471 - DNA, 23 bp, Artificial Sequence
  Synthetic construct
atcgaaggcacctgggaggagag

SEQ ID NO: 11472 - DNA, 23 bp, Artificial Sequence
  Synthetic construct
tcgaaggcacctgggaggagagc

SEQ ID NO: 11473 - DNA, 23 bp, Artificial Sequence
  Synthetic construct
cgaaggcacctgggaggagagcc

SEQ ID NO: 11474 - DNA, 23 bp, Artificial Sequence
  Synthetic construct
gaaggcacctgggaggagagccg

SEQ ID NO: 11475 - DNA, 23 bp, Artificial Sequence
  Synthetic construct
aaggcacctgggaggagagccgt

SEQ ID NO: 11476 - DNA, 23 bp, Artificial Sequence
  Synthetic construct
aggcacctgggaggagagccgta

SEQ ID NO: 11477 - DNA, 23 bp, Artificial Sequence
  Synthetic construct
ggcacctgggaggagagccgtac

SEQ ID NO: 11478 - DNA, 23 bp, Artificial Sequence
  Synthetic construct
gcacctgggaggagagccgtacc

SEQ ID NO: 11479 - DNA, 23 bp, Artificial Sequence
  Synthetic construct
cacctgggaggagagccgtaccc

SEQ ID NO: 11480 - DNA, 23 bp, Artificial Sequence
  Synthetic construct
acctgggaggagagccgtaccca

SEQ ID NO: 11481 - DNA, 23 bp, Artificial Sequence
  Synthetic construct
cctgggaggagagccgtacccac

SEQ ID NO: 11482 - DNA, 23 bp, Artificial Sequence
  Synthetic construct
ctgggaggagagccgtacccaca

SEQ ID NO: 11483 - DNA, 23 bp, Artificial Sequence
  Synthetic construct
tgggaggagagccgtacccacac

SEQ ID NO: 11484 - DNA, 23 bp, Artificial Sequence
  Synthetic construct
gggaggagagccgtacccacacc

SEQ ID NO: 11485 - DNA, 23 bp, Artificial Sequence
  Synthetic construct
ggaggagagccgtacccacacct

SEQ ID NO: 11486 - DNA, 23 bp, Artificial Sequence
  Synthetic construct
gaggagagccgtacccacacctt

SEQ ID NO: 11487 - DNA, 23 bp, Artificial Sequence
  Synthetic construct
aggagagccgtacccacacctta

SEQ ID NO: 11488 - DNA, 23 bp, Artificial Sequence
  Synthetic construct
ggagagccgtacccacaccttat

SEQ ID NO: 11489 - DNA, 23 bp, Artificial Sequence
  Synthetic construct
gagagccgtacccacaccttata

SEQ ID NO: 11490 - DNA, 23 bp, Artificial Sequence
  Synthetic construct
agagccgtacccacaccttatag

SEQ ID NO: 11491 - DNA, 23 bp, Artificial Sequence
  Synthetic construct
gagccgtacccacaccttataga

SEQ ID NO: 11492 - DNA, 23 bp, Artificial Sequence
  Synthetic construct
agccgtacccacaccttatagag

SEQ ID NO: 11493 - DNA, 23 bp, Artificial Sequence
  Synthetic construct
gccgtacccacaccttatagagg

SEQ ID NO: 11494 - DNA, 23 bp, Artificial Sequence
  Synthetic construct
ccgtacccacaccttatagaggc

SEQ ID NO: 11495 - DNA, 23 bp, Artificial Sequence
  Synthetic construct
cgtacccacaccttatagaggcg

SEQ ID NO: 11496 - DNA, 23 bp, Artificial Sequence
  Synthetic construct
gtacccacaccttatagaggcgt

SEQ ID NO: 11497 - DNA, 23 bp, Artificial Sequence
  Synthetic construct
tacccacaccttatagaggcgtg

SEQ ID NO: 11498 - DNA, 23 bp, Artificial Sequence
  Synthetic construct
acccacaccttatagaggcgtgg

SEQ ID NO: 11499 - DNA, 23 bp, Artificial Sequence
  Synthetic construct
cccacaccttatagaggcgtgga

SEQ ID NO: 11500 - DNA, 23 bp, Artificial Sequence
  Synthetic construct
ccacaccttatagaggcgtggat

SEQ ID NO: 11501 - DNA, 23 bp, Artificial Sequence
  Synthetic construct
cacaccttatagaggcgtggatc

SEQ ID NO: 11502 - DNA, 23 bp, Artificial Sequence
  Synthetic construct
acaccttatagaggcgtggatct

SEQ ID NO: 11503 - DNA, 23 bp, Artificial Sequence
  Synthetic construct
caccttatagaggcgtggatctg

SEQ ID NO: 11504 - DNA, 23 bp, Artificial Sequence
  Synthetic construct
accttatagaggcgtggatctga

SEQ ID NO: 11505 - DNA, 23 bp, Artificial Sequence
  Synthetic construct
ccttatagaggcgtggatctgac

SEQ ID NO: 11506 - DNA, 23 bp, Artificial Sequence
  Synthetic construct
cttatagaggcgtggatctgaca

SEQ ID NO: 11507 - DNA, 23 bp, Artificial Sequence
  Synthetic construct
ttatagaggcgtggatctgacat

SEQ ID NO: 11508 - DNA, 23 bp, Artificial Sequence
  Synthetic construct
tatagaggcgtggatctgacata

SEQ ID NO: 11509 - DNA, 23 bp, Artificial Sequence
  Synthetic construct
atagaggcgtggatctgacatac

SEQ ID NO: 11510 - DNA, 23 bp, Artificial Sequence
  Synthetic construct
tagaggcgtggatctgacatacc

SEQ ID NO: 11511 - DNA, 23 bp, Artificial Sequence
  Synthetic construct
agaggcgtggatctgacatacct

SEQ ID NO: 11512 - DNA, 23 bp, Artificial Sequence
  Synthetic construct
gaggcgtggatctgacatacctc

SEQ ID NO: 11513 - DNA, 23 bp, Artificial Sequence
  Synthetic construct
aggcgtggatctgacatacctcc

SEQ ID NO: 11514 - DNA, 23 bp, Artificial Sequence
  Synthetic construct
ggcgtggatctgacatacctccg

SEQ ID NO: 11515 - DNA, 23 bp, Artificial Sequence
  Synthetic construct
gcgtggatctgacatacctccga

SEQ ID NO: 11516 - DNA, 23 bp, Artificial Sequence
  Synthetic construct
cgtggatctgacatacctccgac

SEQ ID NO: 11517 - DNA, 23 bp, Artificial Sequence
  Synthetic construct
gtggatctgacatacctccgaca

SEQ ID NO: 11518 - DNA, 23 bp, Artificial Sequence
  Synthetic construct
tggatctgacatacctccgacaa

SEQ ID NO: 11519 - DNA, 23 bp, Artificial Sequence
  Synthetic construct
ggatctgacatacctccgacaac

SEQ ID NO: 11520 - DNA, 23 bp, Artificial Sequence
  Synthetic construct
gatctgacatacctccgacaact

SEQ ID NO: 11521 - DNA, 23 bp, Artificial Sequence
  Synthetic construct
atctgacatacctccgacaactc

SEQ ID NO: 11522 - DNA, 23 bp, Artificial Sequence
  Synthetic construct
tctgacatacctccgacaactcc

SEQ ID NO: 11523 - DNA, 23 bp, Artificial Sequence
  Synthetic construct
ctgacatacctccgacaactccc

SEQ ID NO: 11524 - DNA, 23 bp, Artificial Sequence
  Synthetic construct
tgacatacctccgacaactcccc

SEQ ID NO: 11525 - DNA, 23 bp, Artificial Sequence
  Synthetic construct
gacatacctccgacaactcccca

SEQ ID NO: 11526 - DNA, 23 bp, Artificial Sequence
  Synthetic construct
acatacctccgacaactccccaa

SEQ ID NO: 11527 - DNA, 23 bp, Artificial Sequence
  Synthetic construct
catacctccgacaactccccaac

SEQ ID NO: 11528 - DNA, 23 bp, Artificial Sequence
  Synthetic construct
atacctccgacaactccccaacc

SEQ ID NO: 11529 - DNA, 23 bp, Artificial Sequence
  Synthetic construct
tacctccgacaactccccaaccc

SEQ ID NO: 11530 - DNA, 23 bp, Artificial Sequence
  Synthetic construct
acctccgacaactccccaacccc

SEQ ID NO: 11531 - DNA, 23 bp, Artificial Sequence
  Synthetic construct
cctccgacaactccccaaccccg

SEQ ID NO: 11532 - DNA, 23 bp, Artificial Sequence
  Synthetic construct
ctccgacaactccccaaccccgt

SEQ ID NO: 11533 - DNA, 23 bp, Artificial Sequence
  Synthetic construct
tccgacaactccccaaccccgta

SEQ ID NO: 11534 - DNA, 23 bp, Artificial Sequence
  Synthetic construct
ccgacaactccccaaccccgtag

SEQ ID NO: 11535 - DNA, 23 bp, Artificial Sequence
  Synthetic construct
cgacaactccccaaccccgtagc

SEQ ID NO: 11536 - DNA, 23 bp, Artificial Sequence
  Synthetic construct
gacaactccccaaccccgtagcc

SEQ ID NO: 11537 - DNA, 23 bp, Artificial Sequence
  Synthetic construct
acaactccccaaccccgtagccg

SEQ ID NO: 11538 - DNA, 23 bp, Artificial Sequence
  Synthetic construct
caactccccaaccccgtagccga

SEQ ID NO: 11539 - DNA, 23 bp, Artificial Sequence
  Synthetic construct
aactccccaaccccgtagccgat

SEQ ID NO: 11540 - DNA, 23 bp, Artificial Sequence
  Synthetic construct
actccccaaccccgtagccgatt

SEQ ID NO: 11541 - DNA, 23 bp, Artificial Sequence
  Synthetic construct
ctccccaaccccgtagccgattt

SEQ ID NO: 11542 - DNA, 23 bp, Artificial Sequence
  Synthetic construct
tccccaaccccgtagccgattta

SEQ ID NO: 11543 - DNA, 23 bp, Artificial Sequence
  Synthetic construct
ccccaaccccgtagccgatttaa

SEQ ID NO: 11544 - DNA, 23 bp, Artificial Sequence
  Synthetic construct
cccaaccccgtagccgatttaat

SEQ ID NO: 11545 - DNA, 23 bp, Artificial Sequence
  Synthetic construct
ccaaccccgtagccgatttaata

SEQ ID NO: 11546 - DNA, 23 bp, Artificial Sequence
  Synthetic construct
caaccccgtagccgatttaatat

SEQ ID NO: 11547 - DNA, 23 bp, Artificial Sequence
  Synthetic construct
aaccccgtagccgatttaatatc

SEQ ID NO: 11548 - DNA, 23 bp, Artificial Sequence
  Synthetic construct
accccgtagccgatttaatatca

SEQ ID NO: 11549 - DNA, 23 bp, Artificial Sequence
  Synthetic construct
ccccgtagccgatttaatatcag

SEQ ID NO: 11550 - DNA, 23 bp, Artificial Sequence
  Synthetic construct
cccgtagccgatttaatatcagc

SEQ ID NO: 11551 - DNA, 23 bp, Artificial Sequence
  Synthetic construct
ccgtagccgatttaatatcagca

SEQ ID NO: 11552 - DNA, 23 bp, Artificial Sequence
  Synthetic construct
cgtagccgatttaatatcagcat

SEQ ID NO: 11553 - DNA, 23 bp, Artificial Sequence
  Synthetic construct
gtagccgatttaatatcagcatc

SEQ ID NO: 11554 - DNA, 23 bp, Artificial Sequence
  Synthetic construct
tagccgatttaatatcagcatca

SEQ ID NO: 11555 - DNA, 23 bp, Artificial Sequence
  Synthetic construct
agccgatttaatatcagcatcag

SEQ ID NO: 11556 - DNA, 23 bp, Artificial Sequence
  Synthetic construct
gccgatttaatatcagcatcagg

SEQ ID NO: 11557 - DNA, 23 bp, Artificial Sequence
  Synthetic construct
ccgatttaatatcagcatcaggg

SEQ ID NO: 11558 - DNA, 23 bp, Artificial Sequence
  Synthetic construct
cgatttaatatcagcatcagggc

SEQ ID NO: 11559 - DNA, 23 bp, Artificial Sequence
  Synthetic construct
gatttaatatcagcatcagggcg

SEQ ID NO: 11560 - DNA, 23 bp, Artificial Sequence
  Synthetic construct
atttaatatcagcatcagggcga

SEQ ID NO: 11561 - DNA, 23 bp, Artificial Sequence
  Synthetic construct
tttaatatcagcatcagggcgaa

SEQ ID NO: 11562 - DNA, 23 bp, Artificial Sequence
  Synthetic construct
ttaatatcagcatcagggcgaag

SEQ ID NO: 11563 - DNA, 23 bp, Artificial Sequence
  Synthetic construct
taatatcagcatcagggcgaaga

SEQ ID NO: 11564 - DNA, 23 bp, Artificial Sequence
  Synthetic construct
aatatcagcatcagggcgaagag

SEQ ID NO: 11565 - DNA, 23 bp, Artificial Sequence
  Synthetic construct
atatcagcatcagggcgaagaga

SEQ ID NO: 11566 - DNA, 23 bp, Artificial Sequence
  Synthetic construct
tatcagcatcagggcgaagagat

SEQ ID NO: 11567 - DNA, 23 bp, Artificial Sequence
  Synthetic construct
atcagcatcagggcgaagagatt

SEQ ID NO: 11568 - DNA, 23 bp, Artificial Sequence
  Synthetic construct
tcagcatcagggcgaagagattg

SEQ ID NO: 11569 - DNA, 23 bp, Artificial Sequence
  Synthetic construct
cagcatcagggcgaagagattgt

SEQ ID NO: 11570 - DNA, 23 bp, Artificial Sequence
  Synthetic construct
agcatcagggcgaagagattgtc

SEQ ID NO: 11571 - DNA, 23 bp, Artificial Sequence
  Synthetic construct
gcatcagggcgaagagattgtca

SEQ ID NO: 11572 - DNA, 23 bp, Artificial Sequence
  Synthetic construct
catcagggcgaagagattgtcaa

SEQ ID NO: 11573 - DNA, 23 bp, Artificial Sequence
  Synthetic construct
atcagggcgaagagattgtcaac

SEQ ID NO: 11574 - DNA, 23 bp, Artificial Sequence
  Synthetic construct
tcagggcgaagagattgtcaaca

SEQ ID NO: 11575 - DNA, 23 bp, Artificial Sequence
  Synthetic construct
cagggcgaagagattgtcaacag

SEQ ID NO: 11576 - DNA, 23 bp, Artificial Sequence
  Synthetic construct
agggcgaagagattgtcaacagg

SEQ ID NO: 11577 - DNA, 23 bp, Artificial Sequence
  Synthetic construct
gggcgaagagattgtcaacaggt

SEQ ID NO: 11578 - DNA, 23 bp, Artificial Sequence
  Synthetic construct
ggcgaagagattgtcaacaggtt

SEQ ID NO: 11579 - DNA, 23 bp, Artificial Sequence
  Synthetic construct
gcgaagagattgtcaacaggttt

SEQ ID NO: 11580 - DNA, 23 bp, Artificial Sequence
  Synthetic construct
cgaagagattgtcaacaggtttc

SEQ ID NO: 11581 - DNA, 23 bp, Artificial Sequence
  Synthetic construct
gaagagattgtcaacaggtttct

SEQ ID NO: 11582 - DNA, 23 bp, Artificial Sequence
  Synthetic construct
aagagattgtcaacaggtttctt

SEQ ID NO: 11583 - DNA, 23 bp, Artificial Sequence
  Synthetic construct
agagattgtcaacaggtttcttg

SEQ ID NO: 11584 - DNA, 23 bp, Artificial Sequence
  Synthetic construct
gagattgtcaacaggtttcttga

SEQ ID NO: 11585 - DNA, 23 bp, Artificial Sequence
  Synthetic construct
agattgtcaacaggtttcttgat

SEQ ID NO: 11586 - DNA, 23 bp, Artificial Sequence
  Synthetic construct
gattgtcaacaggtttcttgatg

SEQ ID NO: 11587 - DNA, 23 bp, Artificial Sequence
  Synthetic construct
attgtcaacaggtttcttgatgt

SEQ ID NO: 11588 - DNA, 23 bp, Artificial Sequence
  Synthetic construct
ttgtcaacaggtttcttgatgta

SEQ ID NO: 11589 - DNA, 23 bp, Artificial Sequence
  Synthetic construct
tgtcaacaggtttcttgatgtaa

SEQ ID NO: 11590 - DNA, 23 bp, Artificial Sequence
  Synthetic construct
gtcaacaggtttcttgatgtaaa

SEQ ID NO: 11591 - DNA, 23 bp, Artificial Sequence
  Synthetic construct
tcaacaggtttcttgatgtaaaa

SEQ ID NO: 11592 - DNA, 23 bp, Artificial Sequence
  Synthetic construct
caacaggtttcttgatgtaaaac

SEQ ID NO: 11593 - DNA, 23 bp, Artificial Sequence
  Synthetic construct
aacaggtttcttgatgtaaaacg

SEQ ID NO: 11594 - DNA, 23 bp, Artificial Sequence
  Synthetic construct
acaggtttcttgatgtaaaacgg

SEQ ID NO: 11595 - DNA, 23 bp, Artificial Sequence
  Synthetic construct
caggtttcttgatgtaaaacggt

SEQ ID NO: 11596 - DNA, 23 bp, Artificial Sequence
  Synthetic construct
aggtttcttgatgtaaaacggtt

SEQ ID NO: 11597 - DNA, 23 bp, Artificial Sequence
  Synthetic construct
ggtttcttgatgtaaaacggttt

SEQ ID NO: 11598 - DNA, 23 bp, Artificial Sequence
  Synthetic construct
gtttcttgatgtaaaacggtttg

SEQ ID NO: 11599 - DNA, 23 bp, Artificial Sequence
  Synthetic construct
tttcttgatgtaaaacggtttga

SEQ ID NO: 11600 - DNA, 23 bp, Artificial Sequence
  Synthetic construct
ttcttgatgtaaaacggtttgac

SEQ ID NO: 11601 - DNA, 23 bp, Artificial Sequence
  Synthetic construct
tcttgatgtaaaacggtttgaca

SEQ ID NO: 11602 - DNA, 23 bp, Artificial Sequence
  Synthetic construct
cttgatgtaaaacggtttgacat

SEQ ID NO: 11603 - DNA, 23 bp, Artificial Sequence
  Synthetic construct
ttgatgtaaaacggtttgacatc

SEQ ID NO: 11604 - DNA, 23 bp, Artificial Sequence
  Synthetic construct
tgatgtaaaacggtttgacatcg

SEQ ID NO: 11605 - DNA, 23 bp, Artificial Sequence
  Synthetic construct
gatgtaaaacggtttgacatcga

SEQ ID NO: 11606 - DNA, 23 bp, Artificial Sequence
  Synthetic construct
atgtaaaacggtttgacatcgac

SEQ ID NO: 11607 - DNA, 23 bp, Artificial Sequence
  Synthetic construct
tgtaaaacggtttgacatcgaca

SEQ ID NO: 11608 - DNA, 23 bp, Artificial Sequence
  Synthetic construct
gtaaaacggtttgacatcgacac

SEQ ID NO: 11609 - DNA, 23 bp, Artificial Sequence
  Synthetic construct
taaaacggtttgacatcgacacc

SEQ ID NO: 11610 - DNA, 23 bp, Artificial Sequence
  Synthetic construct
aaaacggtttgacatcgacacca

SEQ ID NO: 11611 - DNA, 23 bp, Artificial Sequence
  Synthetic construct
aaacggtttgacatcgacaccac

SEQ ID NO: 11612 - DNA, 23 bp, Artificial Sequence
  Synthetic construct
aacggtttgacatcgacaccacg

SEQ ID NO: 11613 - DNA, 23 bp, Artificial Sequence
  Synthetic construct
acggtttgacatcgacaccacgg

SEQ ID NO: 11614 - DNA, 23 bp, Artificial Sequence
  Synthetic construct
cggtttgacatcgacaccacggt

SEQ ID NO: 11615 - DNA, 23 bp, Artificial Sequence
  Synthetic construct
ggtttgacatcgacaccacggta

SEQ ID NO: 11616 - DNA, 23 bp, Artificial Sequence
  Synthetic construct
gtttgacatcgacaccacggtaa

SEQ ID NO: 11617 - DNA, 23 bp, Artificial Sequence
  Synthetic construct
tttgacatcgacaccacggtaaa

SEQ ID NO: 11618 - DNA, 23 bp, Artificial Sequence
  Synthetic construct
ttgacatcgacaccacggtaaaa

SEQ ID NO: 11619 - DNA, 23 bp, Artificial Sequence
  Synthetic construct
tgacatcgacaccacggtaaaag

SEQ ID NO: 11620 - DNA, 23 bp, Artificial Sequence
  Synthetic construct
gacatcgacaccacggtaaaagt

SEQ ID NO: 11621 - DNA, 23 bp, Artificial Sequence
  Synthetic construct
acatcgacaccacggtaaaagtg

SEQ ID NO: 11622 - DNA, 23 bp, Artificial Sequence
  Synthetic construct
catcgacaccacggtaaaagtgc

SEQ ID NO: 11623 - DNA, 23 bp, Artificial Sequence
  Synthetic construct
atcgacaccacggtaaaagtgcg

SEQ ID NO: 11624 - DNA, 23 bp, Artificial Sequence
  Synthetic construct
tcgacaccacggtaaaagtgcgc

SEQ ID NO: 11625 - DNA, 23 bp, Artificial Sequence
  Synthetic construct
cgacaccacggtaaaagtgcgcg

SEQ ID NO: 11626 - DNA, 23 bp, Artificial Sequence
  Synthetic construct
gacaccacggtaaaagtgcgcgc

SEQ ID NO: 11627 - DNA, 23 bp, Artificial Sequence
  Synthetic construct
acaccacggtaaaagtgcgcgcc

SEQ ID NO: 11628 - DNA, 23 bp, Artificial Sequence
  Synthetic construct
caccacggtaaaagtgcgcgccg

SEQ ID NO: 11629 - DNA, 23 bp, Artificial Sequence
  Synthetic construct
accacggtaaaagtgcgcgccgc

SEQ ID NO: 11630 - DNA, 23 bp, Artificial Sequence
  Synthetic construct
ccacggtaaaagtgcgcgccgca

SEQ ID NO: 11631 - DNA, 23 bp, Artificial Sequence
  Synthetic construct
cacggtaaaagtgcgcgccgcag

SEQ ID NO: 11632 - DNA, 23 bp, Artificial Sequence
  Synthetic construct
acggtaaaagtgcgcgccgcagc

SEQ ID NO: 11633 - DNA, 23 bp, Artificial Sequence
  Synthetic construct
cggtaaaagtgcgcgccgcagct

SEQ ID NO: 11634 - DNA, 23 bp, Artificial Sequence
  Synthetic construct
ggtaaaagtgcgcgccgcagctc

SEQ ID NO: 11635 - DNA, 23 bp, Artificial Sequence
  Synthetic construct
gtaaaagtgcgcgccgcagctct

SEQ ID NO: 11636 - DNA, 23 bp, Artificial Sequence
  Synthetic construct
taaaagtgcgcgccgcagctctc

SEQ ID NO: 11637 - DNA, 23 bp, Artificial Sequence
  Synthetic construct
aaaagtgcgcgccgcagctctcg

SEQ ID NO: 11638 - DNA, 23 bp, Artificial Sequence
  Synthetic construct
aaagtgcgcgccgcagctctcgc

SEQ ID NO: 11639 - DNA, 23 bp, Artificial Sequence
  Synthetic construct
aagtgcgcgccgcagctctcgcg

SEQ ID NO: 11640 - DNA, 23 bp, Artificial Sequence
  Synthetic construct
agtgcgcgccgcagctctcgcga

SEQ ID NO: 11641 - DNA, 23 bp, Artificial Sequence
  Synthetic construct
gtgcgcgccgcagctctcgcgaa

SEQ ID NO: 11642 - DNA, 23 bp, Artificial Sequence
  Synthetic construct
tgcgcgccgcagctctcgcgaaa

SEQ ID NO: 11643 - DNA, 23 bp, Artificial Sequence
  Synthetic construct
gcgcgccgcagctctcgcgaaag

SEQ ID NO: 11644 - DNA, 23 bp, Artificial Sequence
  Synthetic construct
cgcgccgcagctctcgcgaaaga

SEQ ID NO: 11645 - DNA, 23 bp, Artificial Sequence
  Synthetic construct
gcgccgcagctctcgcgaaagag

SEQ ID NO: 11646 - DNA, 23 bp, Artificial Sequence
  Synthetic construct
cgccgcagctctcgcgaaagagc

SEQ ID NO: 11647 - DNA, 23 bp, Artificial Sequence
  Synthetic construct
gccgcagctctcgcgaaagagcc

SEQ ID NO: 11648 - DNA, 23 bp, Artificial Sequence
  Synthetic construct
ccgcagctctcgcgaaagagccc

SEQ ID NO: 11649 - DNA, 23 bp, Artificial Sequence
  Synthetic construct
cgcagctctcgcgaaagagcccg

SEQ ID NO: 11650 - DNA, 23 bp, Artificial Sequence
  Synthetic construct
gcagctctcgcgaaagagcccgg

SEQ ID NO: 11651 - DNA, 23 bp, Artificial Sequence
  Synthetic construct
cagctctcgcgaaagagcccgga

SEQ ID NO: 11652 - DNA, 23 bp, Artificial Sequence
  Synthetic construct
agctctcgcgaaagagcccggac

SEQ ID NO: 11653 - DNA, 23 bp, Artificial Sequence
  Synthetic construct
gctctcgcgaaagagcccggaca

SEQ ID NO: 11654 - DNA, 23 bp, Artificial Sequence
  Synthetic construct
ctctcgcgaaagagcccggacac

SEQ ID NO: 11655 - DNA, 23 bp, Artificial Sequence
  Synthetic construct
tctcgcgaaagagcccggacacg

SEQ ID NO: 11656 - DNA, 23 bp, Artificial Sequence
  Synthetic construct
ctcgcgaaagagcccggacacga

SEQ ID NO: 11657 - DNA, 23 bp, Artificial Sequence
  Synthetic construct
tcgcgaaagagcccggacacgaa

SEQ ID NO: 11658 - DNA, 23 bp, Artificial Sequence
  Synthetic construct
cgcgaaagagcccggacacgaac

SEQ ID NO: 11659 - DNA, 23 bp, Artificial Sequence
  Synthetic construct
gcgaaagagcccggacacgaacg

SEQ ID NO: 11660 - DNA, 23 bp, Artificial Sequence
  Synthetic construct
cgaaagagcccggacacgaacgt

SEQ ID NO: 11661 - DNA, 23 bp, Artificial Sequence
  Synthetic construct
gaaagagcccggacacgaacgtt

SEQ ID NO: 11662 - DNA, 23 bp, Artificial Sequence
  Synthetic construct
aaagagcccggacacgaacgttt

SEQ ID NO: 11663 - DNA, 23 bp, Artificial Sequence
  Synthetic construct
aagagcccggacacgaacgtttt

SEQ ID NO: 11664 - DNA, 23 bp, Artificial Sequence
  Synthetic construct
agagcccggacacgaacgtttta

SEQ ID NO: 11665 - DNA, 23 bp, Artificial Sequence
  Synthetic construct
gagcccggacacgaacgttttac

SEQ ID NO: 11666 - DNA, 23 bp, Artificial Sequence
  Synthetic construct
agcccggacacgaacgttttacg

SEQ ID NO: 11667 - DNA, 23 bp, Artificial Sequence
  Synthetic construct
gcccggacacgaacgttttacga

SEQ ID NO: 11668 - DNA, 23 bp, Artificial Sequence
  Synthetic construct
cccggacacgaacgttttacgaa

SEQ ID NO: 11669 - DNA, 23 bp, Artificial Sequence
  Synthetic construct
ccggacacgaacgttttacgaag

SEQ ID NO: 11670 - DNA, 23 bp, Artificial Sequence
  Synthetic construct
cggacacgaacgttttacgaaga

SEQ ID NO: 11671 - DNA, 23 bp, Artificial Sequence
  Synthetic construct
ggacacgaacgttttacgaagat

SEQ ID NO: 11672 - DNA, 23 bp, Artificial Sequence
  Synthetic construct
gacacgaacgttttacgaagatt

SEQ ID NO: 11673 - DNA, 23 bp, Artificial Sequence
  Synthetic construct
acacgaacgttttacgaagattc

SEQ ID NO: 11674 - DNA, 23 bp, Artificial Sequence
  Synthetic construct
cacgaacgttttacgaagattcg

SEQ ID NO: 11675 - DNA, 23 bp, Artificial Sequence
  Synthetic construct
acgaacgttttacgaagattcgg

SEQ ID NO: 11676 - DNA, 23 bp, Artificial Sequence
  Synthetic construct
cgaacgttttacgaagattcggt

SEQ ID NO: 11677 - DNA, 23 bp, Artificial Sequence
  Synthetic construct
gaacgttttacgaagattcggtt

SEQ ID NO: 11678 - DNA, 23 bp, Artificial Sequence
  Synthetic construct
aacgttttacgaagattcggttt

SEQ ID NO: 11679 - DNA, 23 bp, Artificial Sequence
  Synthetic construct
acgttttacgaagattcggttta

SEQ ID NO: 11680 - DNA, 23 bp, Artificial Sequence
  Synthetic construct
cgttttacgaagattcggtttaa

SEQ ID NO: 11681 - DNA, 23 bp, Artificial Sequence
  Synthetic construct
gttttacgaagattcggtttaaa

SEQ ID NO: 11682 - DNA, 23 bp, Artificial Sequence
  Synthetic construct
ttttacgaagattcggtttaaaa

SEQ ID NO: 11683 - DNA, 23 bp, Artificial Sequence
  Synthetic construct
tttacgaagattcggtttaaaac

SEQ ID NO: 11684 - DNA, 23 bp, Artificial Sequence
  Synthetic construct
ttacgaagattcggtttaaaacc

SEQ ID NO: 11685 - DNA, 23 bp, Artificial Sequence
  Synthetic construct
tacgaagattcggtttaaaaccg

SEQ ID NO: 11686 - DNA, 23 bp, Artificial Sequence
  Synthetic construct
acgaagattcggtttaaaaccgt

SEQ ID NO: 11687 - DNA, 23 bp, Artificial Sequence
  Synthetic construct
cgaagattcggtttaaaaccgta

SEQ ID NO: 11688 - DNA, 23 bp, Artificial Sequence
  Synthetic construct
gaagattcggtttaaaaccgtag

SEQ ID NO: 11689 - DNA, 23 bp, Artificial Sequence
  Synthetic construct
aagattcggtttaaaaccgtagt

SEQ ID NO: 11690 - DNA, 23 bp, Artificial Sequence
  Synthetic construct
agattcggtttaaaaccgtagta

SEQ ID NO: 11691 - DNA, 23 bp, Artificial Sequence
  Synthetic construct
gattcggtttaaaaccgtagtag

SEQ ID NO: 11692 - DNA, 23 bp, Artificial Sequence
  Synthetic construct
attcggtttaaaaccgtagtagg

SEQ ID NO: 11693 - DNA, 23 bp, Artificial Sequence
  Synthetic construct
ttcggtttaaaaccgtagtaggc

SEQ ID NO: 11694 - DNA, 23 bp, Artificial Sequence
  Synthetic construct
tcggtttaaaaccgtagtaggca

SEQ ID NO: 11695 - DNA, 23 bp, Artificial Sequence
  Synthetic construct
cggtttaaaaccgtagtaggcaa

SEQ ID NO: 11696 - DNA, 23 bp, Artificial Sequence
  Synthetic construct
ggtttaaaaccgtagtaggcaag

SEQ ID NO: 11697 - DNA, 23 bp, Artificial Sequence
  Synthetic construct
gtttaaaaccgtagtaggcaagt

SEQ ID NO: 11698 - DNA, 23 bp, Artificial Sequence
  Synthetic construct
tttaaaaccgtagtaggcaagtg

SEQ ID NO: 11699 - DNA, 23 bp, Artificial Sequence
  Synthetic construct
ttaaaaccgtagtaggcaagtgc

SEQ ID NO: 11700 - DNA, 23 bp, Artificial Sequence
  Synthetic construct
taaaaccgtagtaggcaagtgcc

SEQ ID NO: 11701 - DNA, 23 bp, Artificial Sequence
  Synthetic construct
aaaaccgtagtaggcaagtgcct

SEQ ID NO: 11702 - DNA, 23 bp, Artificial Sequence
  Synthetic construct
aaaccgtagtaggcaagtgcctc

SEQ ID NO: 11703 - DNA, 23 bp, Artificial Sequence
  Synthetic construct
aaccgtagtaggcaagtgcctct

SEQ ID NO: 11704 - DNA, 23 bp, Artificial Sequence
  Synthetic construct
accgtagtaggcaagtgcctcta

SEQ ID NO: 11705 - DNA, 23 bp, Artificial Sequence
  Synthetic construct
ccgtagtaggcaagtgcctctag

SEQ ID NO: 11706 - DNA, 23 bp, Artificial Sequence
  Synthetic construct
cgtagtaggcaagtgcctctagc

SEQ ID NO: 11707 - DNA, 23 bp, Artificial Sequence
  Synthetic construct
gtagtaggcaagtgcctctagca

SEQ ID NO: 11708 - DNA, 23 bp, Artificial Sequence
  Synthetic construct
tagtaggcaagtgcctctagcac

SEQ ID NO: 11709 - DNA, 23 bp, Artificial Sequence
  Synthetic construct
agtaggcaagtgcctctagcaca

SEQ ID NO: 11710 - DNA, 23 bp, Artificial Sequence
  Synthetic construct
gtaggcaagtgcctctagcacac

SEQ ID NO: 11711 - DNA, 23 bp, Artificial Sequence
  Synthetic construct
taggcaagtgcctctagcacacg

SEQ ID NO: 11712 - DNA, 23 bp, Artificial Sequence
  Synthetic construct
aggcaagtgcctctagcacacgg

SEQ ID NO: 11713 - DNA, 23 bp, Artificial Sequence
  Synthetic construct
ggcaagtgcctctagcacacggg

SEQ ID NO: 11714 - DNA, 23 bp, Artificial Sequence
  Synthetic construct
gcaagtgcctctagcacacgggg

SEQ ID NO: 11715 - DNA, 23 bp, Artificial Sequence
  Synthetic construct
caagtgcctctagcacacggggt

SEQ ID NO: 11716 - DNA, 23 bp, Artificial Sequence
  Synthetic construct
aagtgcctctagcacacggggtg

SEQ ID NO: 11717 - DNA, 23 bp, Artificial Sequence
  Synthetic construct
agtgcctctagcacacggggtgc

SEQ ID NO: 11718 - DNA, 23 bp, Artificial Sequence
  Synthetic construct
gtgcctctagcacacggggtgca

SEQ ID NO: 11719 - DNA, 23 bp, Artificial Sequence
  Synthetic construct
tgcctctagcacacggggtgcaa

SEQ ID NO: 11720 - DNA, 23 bp, Artificial Sequence
  Synthetic construct
gcctctagcacacggggtgcaat

SEQ ID NO: 11721 - DNA, 23 bp, Artificial Sequence
  Synthetic construct
cctctagcacacggggtgcaatc

SEQ ID NO: 11722 - DNA, 23 bp, Artificial Sequence
  Synthetic construct
ctctagcacacggggtgcaatct

SEQ ID NO: 11723 - DNA, 23 bp, Artificial Sequence
  Synthetic construct
tctagcacacggggtgcaatctc

SEQ ID NO: 11724 - DNA, 23 bp, Artificial Sequence
  Synthetic construct
ctagcacacggggtgcaatctca

SEQ ID NO: 11725 - DNA, 23 bp, Artificial Sequence
  Synthetic construct
tagcacacggggtgcaatctcac

SEQ ID NO: 11726 - DNA, 23 bp, Artificial Sequence
  Synthetic construct
agcacacggggtgcaatctcact

SEQ ID NO: 11727 - DNA, 23 bp, Artificial Sequence
  Synthetic construct
gcacacggggtgcaatctcactg

SEQ ID NO: 11728 - DNA, 23 bp, Artificial Sequence
  Synthetic construct
cacacggggtgcaatctcactgg

SEQ ID NO: 11729 - DNA, 23 bp, Artificial Sequence
  Synthetic construct
acacggggtgcaatctcactggg

SEQ ID NO: 11730 - DNA, 23 bp, Artificial Sequence
  Synthetic construct
cacggggtgcaatctcactggga

SEQ ID NO: 11731 - DNA, 23 bp, Artificial Sequence
  Synthetic construct
acggggtgcaatctcactgggac

SEQ ID NO: 11732 - DNA, 23 bp, Artificial Sequence
  Synthetic construct
cggggtgcaatctcactgggaca

SEQ ID NO: 11733 - DNA, 23 bp, Artificial Sequence
  Synthetic construct
ggggtgcaatctcactgggacat

SEQ ID NO: 11734 - DNA, 23 bp, Artificial Sequence
  Synthetic construct
gggtgcaatctcactgggacata

SEQ ID NO: 11735 - DNA, 23 bp, Artificial Sequence
  Synthetic construct
ggtgcaatctcactgggacatat

SEQ ID NO: 11736 - DNA, 23 bp, Artificial Sequence
  Synthetic construct
gtgcaatctcactgggacatata

SEQ ID NO: 11737 - DNA, 23 bp, Artificial Sequence
  Synthetic construct
tgcaatctcactgggacatataa

SEQ ID NO: 11738 - DNA, 23 bp, Artificial Sequence
  Synthetic construct
gcaatctcactgggacatataat

SEQ ID NO: 11739 - DNA, 23 bp, Artificial Sequence
  Synthetic construct
caatctcactgggacatataata

SEQ ID NO: 11740 - DNA, 23 bp, Artificial Sequence
  Synthetic construct
aatctcactgggacatataatat

SEQ ID NO: 11741 - DNA, 23 bp, Artificial Sequence
  Synthetic construct
atctcactgggacatataatatc

SEQ ID NO: 11742 - DNA, 23 bp, Artificial Sequence
  Synthetic construct
tctcactgggacatataatatcg

SEQ ID NO: 11743 - DNA, 23 bp, Artificial Sequence
  Synthetic construct
ctcactgggacatataatatcgt

SEQ ID NO: 11744 - DNA, 23 bp, Artificial Sequence
  Synthetic construct
tcactgggacatataatatcgtc

SEQ ID NO: 11745 - DNA, 23 bp, Artificial Sequence
  Synthetic construct
cactgggacatataatatcgtcc

SEQ ID NO: 11746 - DNA, 23 bp, Artificial Sequence
  Synthetic construct
actgggacatataatatcgtccc

SEQ ID NO: 11747 - DNA, 23 bp, Artificial Sequence
  Synthetic construct
ctgggacatataatatcgtcccc

SEQ ID NO: 11748 - DNA, 23 bp, Artificial Sequence
  Synthetic construct
tgggacatataatatcgtccccg

SEQ ID NO: 11749 - DNA, 23 bp, Artificial Sequence
  Synthetic construct
gggacatataatatcgtccccgt

SEQ ID NO: 11750 - DNA, 23 bp, Artificial Sequence
  Synthetic construct
ggacatataatatcgtccccgta

SEQ ID NO: 11751 - DNA, 23 bp, Artificial Sequence
  Synthetic construct
gacatataatatcgtccccgtag

SEQ ID NO: 11752 - DNA, 23 bp, Artificial Sequence
  Synthetic construct
acatataatatcgtccccgtaga

SEQ ID NO: 11753 - DNA, 23 bp, Artificial Sequence
  Synthetic construct
catataatatcgtccccgtagat

SEQ ID NO: 11754 - DNA, 23 bp, Artificial Sequence
  Synthetic construct
atataatatcgtccccgtagatg

SEQ ID NO: 11755 - DNA, 23 bp, Artificial Sequence
  Synthetic construct
tataatatcgtccccgtagatgc

SEQ ID NO: 11756 - DNA, 23 bp, Artificial Sequence
  Synthetic construct
ataatatcgtccccgtagatgcc

SEQ ID NO: 11757 - DNA, 23 bp, Artificial Sequence
  Synthetic construct
taatatcgtccccgtagatgcct

SEQ ID NO: 11758 - DNA, 23 bp, Artificial Sequence
  Synthetic construct
aatatcgtccccgtagatgccta

SEQ ID NO: 11759 - DNA, 23 bp, Artificial Sequence
  Synthetic construct
atatcgtccccgtagatgcctat

SEQ ID NO: 11760 - DNA, 23 bp, Artificial Sequence
  Synthetic construct
tatcgtccccgtagatgcctatg

SEQ ID NO: 11761 - DNA, 23 bp, Artificial Sequence
  Synthetic construct
atcgtccccgtagatgcctatgg

SEQ ID NO: 11762 - DNA, 23 bp, Artificial Sequence
  Synthetic construct
tcgtccccgtagatgcctatggt

SEQ ID NO: 11763 - DNA, 23 bp, Artificial Sequence
  Synthetic construct
cgtccccgtagatgcctatggtt

SEQ ID NO: 11764 - DNA, 23 bp, Artificial Sequence
  Synthetic construct
gtccccgtagatgcctatggttc

SEQ ID NO: 11765 - DNA, 23 bp, Artificial Sequence
  Synthetic construct
tccccgtagatgcctatggttcc

SEQ ID NO: 11766 - DNA, 23 bp, Artificial Sequence
  Synthetic construct
ccccgtagatgcctatggttccg

SEQ ID NO: 11767 - DNA, 23 bp, Artificial Sequence
  Synthetic construct
cccgtagatgcctatggttccgg

SEQ ID NO: 11768 - DNA, 23 bp, Artificial Sequence
  Synthetic construct
ccgtagatgcctatggttccggc

SEQ ID NO: 11769 - DNA, 23 bp, Artificial Sequence
  Synthetic construct
cgtagatgcctatggttccggcg

SEQ ID NO: 11770 - DNA, 23 bp, Artificial Sequence
  Synthetic construct
gtagatgcctatggttccggcgt

SEQ ID NO: 11771 - DNA, 23 bp, Artificial Sequence
  Synthetic construct
tagatgcctatggttccggcgtt

SEQ ID NO: 11772 - DNA, 23 bp, Artificial Sequence
  Synthetic construct
agatgcctatggttccggcgtta

SEQ ID NO: 11773 - DNA, 23 bp, Artificial Sequence
  Synthetic construct
gatgcctatggttccggcgttac

SEQ ID NO: 11774 - DNA, 23 bp, Artificial Sequence
  Synthetic construct
atgcctatggttccggcgttacc

SEQ ID NO: 11775 - DNA, 23 bp, Artificial Sequence
  Synthetic construct
tgcctatggttccggcgttacca

SEQ ID NO: 11776 - DNA, 23 bp, Artificial Sequence
  Synthetic construct
gcctatggttccggcgttaccaa

SEQ ID NO: 11777 - DNA, 23 bp, Artificial Sequence
  Synthetic construct
cctatggttccggcgttaccaaa

SEQ ID NO: 11778 - DNA, 23 bp, Artificial Sequence
  Synthetic construct
ctatggttccggcgttaccaaaa

SEQ ID NO: 11779 - DNA, 23 bp, Artificial Sequence
  Synthetic construct
tatggttccggcgttaccaaaat

SEQ ID NO: 11780 - DNA, 23 bp, Artificial Sequence
  Synthetic construct
atggttccggcgttaccaaaatg

SEQ ID NO: 11781 - DNA, 23 bp, Artificial Sequence
  Synthetic construct
tggttccggcgttaccaaaatgg

SEQ ID NO: 11782 - DNA, 23 bp, Artificial Sequence
  Synthetic construct
ggttccggcgttaccaaaatgga

SEQ ID NO: 11783 - DNA, 23 bp, Artificial Sequence
  Synthetic construct
gttccggcgttaccaaaatggat

SEQ ID NO: 11784 - DNA, 23 bp, Artificial Sequence
  Synthetic construct
ttccggcgttaccaaaatggatt

SEQ ID NO: 11785 - DNA, 23 bp, Artificial Sequence
  Synthetic construct
tccggcgttaccaaaatggattt

SEQ ID NO: 11786 - DNA, 23 bp, Artificial Sequence
  Synthetic construct
ccggcgttaccaaaatggatttg

SEQ ID NO: 11787 - DNA, 23 bp, Artificial Sequence
  Synthetic construct
cggcgttaccaaaatggatttgg

SEQ ID NO: 11788 - DNA, 23 bp, Artificial Sequence
  Synthetic construct
ggcgttaccaaaatggatttggg

SEQ ID NO: 11789 - DNA, 23 bp, Artificial Sequence
  Synthetic construct
gcgttaccaaaatggatttgggt

SEQ ID NO: 11790 - DNA, 23 bp, Artificial Sequence
  Synthetic construct
cgttaccaaaatggatttgggtc

SEQ ID NO: 11791 - DNA, 23 bp, Artificial Sequence
  Synthetic construct
gttaccaaaatggatttgggtcg

SEQ ID NO: 11792 - DNA, 23 bp, Artificial Sequence
  Synthetic construct
ttaccaaaatggatttgggtcgc

SEQ ID NO: 11793 - DNA, 23 bp, Artificial Sequence
  Synthetic construct
taccaaaatggatttgggtcgct

SEQ ID NO: 11794 - DNA, 23 bp, Artificial Sequence
  Synthetic construct
accaaaatggatttgggtcgctt

SEQ ID NO: 11795 - DNA, 23 bp, Artificial Sequence
  Synthetic construct
ccaaaatggatttgggtcgcttt

SEQ ID NO: 11796 - DNA, 23 bp, Artificial Sequence
  Synthetic construct
caaaatggatttgggtcgctttg

SEQ ID NO: 11797 - DNA, 23 bp, Artificial Sequence
  Synthetic construct
aaaatggatttgggtcgctttga

SEQ ID NO: 11798 - DNA, 23 bp, Artificial Sequence
  Synthetic construct
aaatggatttgggtcgctttgac

SEQ ID NO: 11799 - DNA, 23 bp, Artificial Sequence
  Synthetic construct
aatggatttgggtcgctttgact

SEQ ID NO: 11800 - DNA, 23 bp, Artificial Sequence
  Synthetic construct
atggatttgggtcgctttgacta

SEQ ID NO: 11801 - DNA, 23 bp, Artificial Sequence
  Synthetic construct
tggatttgggtcgctttgactat

SEQ ID NO: 11802 - DNA, 23 bp, Artificial Sequence
  Synthetic construct
ggatttgggtcgctttgactatt

SEQ ID NO: 11803 - DNA, 23 bp, Artificial Sequence
  Synthetic construct
gatttgggtcgctttgactattg

SEQ ID NO: 11804 - DNA, 23 bp, Artificial Sequence
  Synthetic construct
atttgggtcgctttgactattgc

SEQ ID NO: 11805 - DNA, 23 bp, Artificial Sequence
  Synthetic construct
tttgggtcgctttgactattgcc

SEQ ID NO: 11806 - DNA, 23 bp, Artificial Sequence
  Synthetic construct
ttgggtcgctttgactattgccc

SEQ ID NO: 11807 - DNA, 23 bp, Artificial Sequence
  Synthetic construct
tgggtcgctttgactattgccca

SEQ ID NO: 11808 - DNA, 23 bp, Artificial Sequence
  Synthetic construct
gggtcgctttgactattgcccag

SEQ ID NO: 11809 - DNA, 23 bp, Artificial Sequence
  Synthetic construct
ggtcgctttgactattgcccaga

SEQ ID NO: 11810 - DNA, 23 bp, Artificial Sequence
  Synthetic construct
gtcgctttgactattgcccagaa

SEQ ID NO: 11811 - DNA, 23 bp, Artificial Sequence
  Synthetic construct
tcgctttgactattgcccagaat

SEQ ID NO: 11812 - DNA, 23 bp, Artificial Sequence
  Synthetic construct
cgctttgactattgcccagaata

SEQ ID NO: 11813 - DNA, 23 bp, Artificial Sequence
  Synthetic construct
gctttgactattgcccagaatat

SEQ ID NO: 11814 - DNA, 23 bp, Artificial Sequence
  Synthetic construct
ctttgactattgcccagaatatc

SEQ ID NO: 11815 - DNA, 23 bp, Artificial Sequence
  Synthetic construct
tttgactattgcccagaatatca

SEQ ID NO: 11816 - DNA, 23 bp, Artificial Sequence
  Synthetic construct
ttgactattgcccagaatatcat

SEQ ID NO: 11817 - DNA, 23 bp, Artificial Sequence
  Synthetic construct
tgactattgcccagaatatcatg

SEQ ID NO: 11818 - DNA, 23 bp, Artificial Sequence
  Synthetic construct
gactattgcccagaatatcatgg

SEQ ID NO: 11819 - DNA, 23 bp, Artificial Sequence
  Synthetic construct
actattgcccagaatatcatgga

SEQ ID NO: 11820 - DNA, 23 bp, Artificial Sequence
  Synthetic construct
ctattgcccagaatatcatggac

SEQ ID NO: 11821 - DNA, 23 bp, Artificial Sequence
  Synthetic construct
tattgcccagaatatcatggact

SEQ ID NO: 11822 - DNA, 23 bp, Artificial Sequence
  Synthetic construct
attgcccagaatatcatggactc

SEQ ID NO: 11823 - DNA, 23 bp, Artificial Sequence
  Synthetic construct
ttgcccagaatatcatggactct

SEQ ID NO: 11824 - DNA, 23 bp, Artificial Sequence
  Synthetic construct
tgcccagaatatcatggactcta

SEQ ID NO: 11825 - DNA, 23 bp, Artificial Sequence
  Synthetic construct
gcccagaatatcatggactctag

SEQ ID NO: 11826 - DNA, 23 bp, Artificial Sequence
  Synthetic construct
cccagaatatcatggactctagc

SEQ ID NO: 11827 - DNA, 23 bp, Artificial Sequence
  Synthetic construct
ccagaatatcatggactctagct

SEQ ID NO: 11828 - DNA, 23 bp, Artificial Sequence
  Synthetic construct
cagaatatcatggactctagctc

SEQ ID NO: 11829 - DNA, 23 bp, Artificial Sequence
  Synthetic construct
agaatatcatggactctagctca

SEQ ID NO: 11830 - DNA, 23 bp, Artificial Sequence
  Synthetic construct
gaatatcatggactctagctcaa

SEQ ID NO: 11831 - DNA, 23 bp, Artificial Sequence
  Synthetic construct
aatatcatggactctagctcaaa

SEQ ID NO: 11832 - DNA, 23 bp, Artificial Sequence
  Synthetic construct
atatcatggactctagctcaaat

SEQ ID NO: 11833 - DNA, 23 bp, Artificial Sequence
  Synthetic construct
tatcatggactctagctcaaatg

SEQ ID NO: 11834 - DNA, 23 bp, Artificial Sequence
  Synthetic construct
atcatggactctagctcaaatgt

SEQ ID NO: 11835 - DNA, 23 bp, Artificial Sequence
  Synthetic construct
tcatggactctagctcaaatgtg

SEQ ID NO: 11836 - DNA, 23 bp, Artificial Sequence
  Synthetic construct
catggactctagctcaaatgtga

SEQ ID NO: 11837 - DNA, 23 bp, Artificial Sequence
  Synthetic construct
atggactctagctcaaatgtgaa

SEQ ID NO: 11838 - DNA, 23 bp, Artificial Sequence
  Synthetic construct
tggactctagctcaaatgtgaac

SEQ ID NO: 11839 - DNA, 23 bp, Artificial Sequence
  Synthetic construct
ggactctagctcaaatgtgaacc

SEQ ID NO: 11840 - DNA, 23 bp, Artificial Sequence
  Synthetic construct
gactctagctcaaatgtgaaccc

SEQ ID NO: 11841 - DNA, 23 bp, Artificial Sequence
  Synthetic construct
actctagctcaaatgtgaaccca

SEQ ID NO: 11842 - DNA, 23 bp, Artificial Sequence
  Synthetic construct
ctctagctcaaatgtgaacccat

SEQ ID NO: 11843 - DNA, 23 bp, Artificial Sequence
  Synthetic construct
tctagctcaaatgtgaacccatt

SEQ ID NO: 11844 - DNA, 23 bp, Artificial Sequence
  Synthetic construct
ctagctcaaatgtgaacccattt

SEQ ID NO: 11845 - DNA, 23 bp, Artificial Sequence
  Synthetic construct
tagctcaaatgtgaacccatttc

SEQ ID NO: 11846 - DNA, 23 bp, Artificial Sequence
  Synthetic construct
agctcaaatgtgaacccatttcc

SEQ ID NO: 11847 - DNA, 23 bp, Artificial Sequence
  Synthetic construct
gctcaaatgtgaacccatttccc

SEQ ID NO: 11848 - DNA, 23 bp, Artificial Sequence
  Synthetic construct
ctcaaatgtgaacccatttccca

SEQ ID NO: 11849 - DNA, 23 bp, Artificial Sequence
  Synthetic construct
tcaaatgtgaacccatttcccat

SEQ ID NO: 11850 - DNA, 23 bp, Artificial Sequence
  Synthetic construct
caaatgtgaacccatttcccatt

SEQ ID NO: 11851 - DNA, 23 bp, Artificial Sequence
  Synthetic construct
aaatgtgaacccatttcccattg

SEQ ID NO: 11852 - DNA, 23 bp, Artificial Sequence
  Synthetic construct
aatgtgaacccatttcccattgt

SEQ ID NO: 11853 - DNA, 23 bp, Artificial Sequence
  Synthetic construct
atgtgaacccatttcccattgtg

SEQ ID NO: 11854 - DNA, 23 bp, Artificial Sequence
  Synthetic construct
tgtgaacccatttcccattgtgg

SEQ ID NO: 11855 - DNA, 23 bp, Artificial Sequence
  Synthetic construct
gtgaacccatttcccattgtgga

SEQ ID NO: 11856 - DNA, 23 bp, Artificial Sequence
  Synthetic construct
tgaacccatttcccattgtggaa

SEQ ID NO: 11857 - DNA, 23 bp, Artificial Sequence
  Synthetic construct
gaacccatttcccattgtggaaa

SEQ ID NO: 11858 - DNA, 23 bp, Artificial Sequence
  Synthetic construct
aacccatttcccattgtggaaaa

SEQ ID NO: 11859 - DNA, 23 bp, Artificial Sequence
  Synthetic construct
acccatttcccattgtggaaaat

SEQ ID NO: 11860 - DNA, 23 bp, Artificial Sequence
  Synthetic construct
cccatttcccattgtggaaaata

SEQ ID NO: 11861 - DNA, 23 bp, Artificial Sequence
  Synthetic construct
ccatttcccattgtggaaaatag

SEQ ID NO: 11862 - DNA, 23 bp, Artificial Sequence
  Synthetic construct
catttcccattgtggaaaatagt

SEQ ID NO: 11863 - DNA, 23 bp, Artificial Sequence
  Synthetic construct
atttcccattgtggaaaatagtt

SEQ ID NO: 11864 - DNA, 23 bp, Artificial Sequence
  Synthetic construct
tttcccattgtggaaaatagttc

SEQ ID NO: 11865 - DNA, 23 bp, Artificial Sequence
  Synthetic construct
ttcccattgtggaaaatagttcc

SEQ ID NO: 11866 - DNA, 23 bp, Artificial Sequence
  Synthetic construct
tcccattgtggaaaatagttccc

SEQ ID NO: 11867 - DNA, 23 bp, Artificial Sequence
  Synthetic construct
cccattgtggaaaatagttccca

SEQ ID NO: 11868 - DNA, 23 bp, Artificial Sequence
  Synthetic construct
ccattgtggaaaatagttcccat

SEQ ID NO: 11869 - DNA, 23 bp, Artificial Sequence
  Synthetic construct
cattgtggaaaatagttcccatc

SEQ ID NO: 11870 - DNA, 23 bp, Artificial Sequence
  Synthetic construct
attgtggaaaatagttcccatcg

SEQ ID NO: 11871 - DNA, 23 bp, Artificial Sequence
  Synthetic construct
ttgtggaaaatagttcccatcgt

SEQ ID NO: 11872 - DNA, 23 bp, Artificial Sequence
  Synthetic construct
tgtggaaaatagttcccatcgta

SEQ ID NO: 11873 - DNA, 23 bp, Artificial Sequence
  Synthetic construct
gtggaaaatagttcccatcgtat

SEQ ID NO: 11874 - DNA, 23 bp, Artificial Sequence
  Synthetic construct
tggaaaatagttcccatcgtatc

SEQ ID NO: 11875 - DNA, 23 bp, Artificial Sequence
  Synthetic construct
ggaaaatagttcccatcgtatcg

SEQ ID NO: 11876 - DNA, 23 bp, Artificial Sequence
  Synthetic construct
gaaaatagttcccatcgtatcgt

SEQ ID NO: 11877 - DNA, 23 bp, Artificial Sequence
  Synthetic construct
aaaatagttcccatcgtatcgtc

SEQ ID NO: 11878 - DNA, 23 bp, Artificial Sequence
  Synthetic construct
aaatagttcccatcgtatcgtct

SEQ ID NO: 11879 - DNA, 23 bp, Artificial Sequence
  Synthetic construct
aatagttcccatcgtatcgtctc

SEQ ID NO: 11880 - DNA, 23 bp, Artificial Sequence
  Synthetic construct
atagttcccatcgtatcgtctcg

SEQ ID NO: 11881 - DNA, 23 bp, Artificial Sequence
  Synthetic construct
tagttcccatcgtatcgtctcgc

SEQ ID NO: 11882 - DNA, 23 bp, Artificial Sequence
  Synthetic construct
agttcccatcgtatcgtctcgcc

SEQ ID NO: 11883 - DNA, 23 bp, Artificial Sequence
  Synthetic construct
gttcccatcgtatcgtctcgcca

SEQ ID NO: 11884 - DNA, 23 bp, Artificial Sequence
  Synthetic construct
ttcccatcgtatcgtctcgccat

SEQ ID NO: 11885 - DNA, 23 bp, Artificial Sequence
  Synthetic construct
tcccatcgtatcgtctcgccatc

SEQ ID NO: 11886 - DNA, 23 bp, Artificial Sequence
  Synthetic construct
cccatcgtatcgtctcgccatct

SEQ ID NO: 11887 - DNA, 23 bp, Artificial Sequence
  Synthetic construct
ccatcgtatcgtctcgccatcta

SEQ ID NO: 11888 - DNA, 23 bp, Artificial Sequence
  Synthetic construct
catcgtatcgtctcgccatctac

SEQ ID NO: 11889 - DNA, 23 bp, Artificial Sequence
  Synthetic construct
atcgtatcgtctcgccatctacg

SEQ ID NO: 11890 - DNA, 23 bp, Artificial Sequence
  Synthetic construct
tcgtatcgtctcgccatctacga

SEQ ID NO: 11891 - DNA, 23 bp, Artificial Sequence
  Synthetic construct
cgtatcgtctcgccatctacgat

SEQ ID NO: 11892 - DNA, 23 bp, Artificial Sequence
  Synthetic construct
gtatcgtctcgccatctacgatt

SEQ ID NO: 11893 - DNA, 23 bp, Artificial Sequence
  Synthetic construct
tatcgtctcgccatctacgattc

SEQ ID NO: 11894 - DNA, 23 bp, Artificial Sequence
  Synthetic construct
atcgtctcgccatctacgattcc

SEQ ID NO: 11895 - DNA, 23 bp, Artificial Sequence
  Synthetic construct
tcgtctcgccatctacgattccg

SEQ ID NO: 11896 - DNA, 23 bp, Artificial Sequence
  Synthetic construct
cgtctcgccatctacgattccgt

SEQ ID NO: 11897 - DNA, 23 bp, Artificial Sequence
  Synthetic construct
gtctcgccatctacgattccgta

SEQ ID NO: 11898 - DNA, 23 bp, Artificial Sequence
  Synthetic construct
tctcgccatctacgattccgtag

SEQ ID NO: 11899 - DNA, 23 bp, Artificial Sequence
  Synthetic construct
ctcgccatctacgattccgtagt

SEQ ID NO: 11900 - DNA, 23 bp, Artificial Sequence
  Synthetic construct
tcgccatctacgattccgtagtg

SEQ ID NO: 11901 - DNA, 23 bp, Artificial Sequence
  Synthetic construct
cgccatctacgattccgtagtgt

SEQ ID NO: 11902 - DNA, 23 bp, Artificial Sequence
  Synthetic construct
gccatctacgattccgtagtgtg

SEQ ID NO: 11903 - DNA, 23 bp, Artificial Sequence
  Synthetic construct
ccatctacgattccgtagtgtga

SEQ ID NO: 11904 - DNA, 23 bp, Artificial Sequence
  Synthetic construct
catctacgattccgtagtgtgag

SEQ ID NO: 11905 - DNA, 23 bp, Artificial Sequence
  Synthetic construct
atctacgattccgtagtgtgagc

SEQ ID NO: 11906 - DNA, 23 bp, Artificial Sequence
  Synthetic construct
tctacgattccgtagtgtgagcg

SEQ ID NO: 11907 - DNA, 23 bp, Artificial Sequence
  Synthetic construct
ctacgattccgtagtgtgagcgg

SEQ ID NO: 11908 - DNA, 23 bp, Artificial Sequence
  Synthetic construct
tacgattccgtagtgtgagcgga

SEQ ID NO: 11909 - DNA, 23 bp, Artificial Sequence
  Synthetic construct
acgattccgtagtgtgagcggat

SEQ ID NO: 11910 - DNA, 23 bp, Artificial Sequence
  Synthetic construct
cgattccgtagtgtgagcggata

SEQ ID NO: 11911 - DNA, 23 bp, Artificial Sequence
  Synthetic construct
gattccgtagtgtgagcggatac

SEQ ID NO: 11912 - DNA, 23 bp, Artificial Sequence
  Synthetic construct
attccgtagtgtgagcggatacg

SEQ ID NO: 11913 - DNA, 23 bp, Artificial Sequence
  Synthetic construct
ttccgtagtgtgagcggatacga

SEQ ID NO: 11914 - DNA, 23 bp, Artificial Sequence
  Synthetic construct
tccgtagtgtgagcggatacgat

SEQ ID NO: 11915 - DNA, 23 bp, Artificial Sequence
  Synthetic construct
ccgtagtgtgagcggatacgatc

SEQ ID NO: 11916 - DNA, 23 bp, Artificial Sequence
  Synthetic construct
cgtagtgtgagcggatacgatcg

SEQ ID NO: 11917 - DNA, 23 bp, Artificial Sequence
  Synthetic construct
gtagtgtgagcggatacgatcga

SEQ ID NO: 11918 - DNA, 23 bp, Artificial Sequence
  Synthetic construct
tagtgtgagcggatacgatcgag

SEQ ID NO: 11919 - DNA, 23 bp, Artificial Sequence
  Synthetic construct
agtgtgagcggatacgatcgaga

SEQ ID NO: 11920 - DNA, 23 bp, Artificial Sequence
  Synthetic construct
gtgtgagcggatacgatcgagat

SEQ ID NO: 11921 - DNA, 23 bp, Artificial Sequence
  Synthetic construct
tgtgagcggatacgatcgagata

SEQ ID NO: 11922 - DNA, 23 bp, Artificial Sequence
  Synthetic construct
gtgagcggatacgatcgagatat

SEQ ID NO: 11923 - DNA, 23 bp, Artificial Sequence
  Synthetic construct
tgagcggatacgatcgagatatg

SEQ ID NO: 11924 - DNA, 23 bp, Artificial Sequence
  Synthetic construct
gagcggatacgatcgagatatga

SEQ ID NO: 11925 - DNA, 23 bp, Artificial Sequence
  Synthetic construct
agcggatacgatcgagatatgaa

SEQ ID NO: 11926 - DNA, 23 bp, Artificial Sequence
  Synthetic construct
gcggatacgatcgagatatgaat

SEQ ID NO: 11927 - DNA, 23 bp, Artificial Sequence
  Synthetic construct
cggatacgatcgagatatgaata

SEQ ID NO: 11928 - DNA, 23 bp, Artificial Sequence
  Synthetic construct
ggatacgatcgagatatgaatat

SEQ ID NO: 11929 - DNA, 23 bp, Artificial Sequence
  Synthetic construct
gatacgatcgagatatgaatata

SEQ ID NO: 11930 - DNA, 23 bp, Artificial Sequence
  Synthetic construct
atacgatcgagatatgaatatag

SEQ ID NO: 11931 - DNA, 23 bp, Artificial Sequence
  Synthetic construct
tacgatcgagatatgaatatagc

SEQ ID NO: 11932 - DNA, 23 bp, Artificial Sequence
  Synthetic construct
acgatcgagatatgaatatagct

SEQ ID NO: 11933 - DNA, 23 bp, Artificial Sequence
  Synthetic construct
cgatcgagatatgaatatagctc

SEQ ID NO: 11934 - DNA, 23 bp, Artificial Sequence
  Synthetic construct
gatcgagatatgaatatagctct

SEQ ID NO: 11935 - DNA, 23 bp, Artificial Sequence
  Synthetic construct
atcgagatatgaatatagctctg

SEQ ID NO: 11936 - DNA, 23 bp, Artificial Sequence
  Synthetic construct
tcgagatatgaatatagctctgg

SEQ ID NO: 11937 - DNA, 23 bp, Artificial Sequence
  Synthetic construct
cgagatatgaatatagctctggt

SEQ ID NO: 11938 - DNA, 23 bp, Artificial Sequence
  Synthetic construct
gagatatgaatatagctctggtg

SEQ ID NO: 11939 - DNA, 23 bp, Artificial Sequence
  Synthetic construct
agatatgaatatagctctggtgg

SEQ ID NO: 11940 - DNA, 23 bp, Artificial Sequence
  Synthetic construct
gatatgaatatagctctggtggg

SEQ ID NO: 11941 - DNA, 23 bp, Artificial Sequence
  Synthetic construct
atatgaatatagctctggtggga

SEQ ID NO: 11942 - DNA, 23 bp, Artificial Sequence
  Synthetic construct
tatgaatatagctctggtgggag

SEQ ID NO: 11943 - DNA, 23 bp, Artificial Sequence
  Synthetic construct
atgaatatagctctggtgggaga

SEQ ID NO: 11944 - DNA, 23 bp, Artificial Sequence
  Synthetic construct
tgaatatagctctggtgggagaa

SEQ ID NO: 11945 - DNA, 23 bp, Artificial Sequence
  Synthetic construct
gaatatagctctggtgggagaaa

SEQ ID NO: 11946 - DNA, 23 bp, Artificial Sequence
  Synthetic construct
aatatagctctggtgggagaaaa

SEQ ID NO: 11947 - DNA, 23 bp, Artificial Sequence
  Synthetic construct
atatagctctggtgggagaaaac

SEQ ID NO: 11948 - DNA, 23 bp, Artificial Sequence
  Synthetic construct
tatagctctggtgggagaaaact

SEQ ID NO: 11949 - DNA, 23 bp, Artificial Sequence
  Synthetic construct
atagctctggtgggagaaaactc

SEQ ID NO: 11950 - DNA, 23 bp, Artificial Sequence
  Synthetic construct
tagctctggtgggagaaaactcc

SEQ ID NO: 11951 - DNA, 23 bp, Artificial Sequence
  Synthetic construct
agctctggtgggagaaaactcca

SEQ ID NO: 11952 - DNA, 23 bp, Artificial Sequence
  Synthetic construct
gctctggtgggagaaaactccac

SEQ ID NO: 11953 - DNA, 23 bp, Artificial Sequence
  Synthetic construct
ctctggtgggagaaaactccaca

SEQ ID NO: 11954 - DNA, 23 bp, Artificial Sequence
  Synthetic construct
tctggtgggagaaaactccacac

SEQ ID NO: 11955 - DNA, 23 bp, Artificial Sequence
  Synthetic construct
ctggtgggagaaaactccacacc

SEQ ID NO: 11956 - DNA, 23 bp, Artificial Sequence
  Synthetic construct
tggtgggagaaaactccacacca

SEQ ID NO: 11957 - DNA, 23 bp, Artificial Sequence
  Synthetic construct
ggtgggagaaaactccacaccag

SEQ ID NO: 11958 - DNA, 23 bp, Artificial Sequence
  Synthetic construct
gtgggagaaaactccacaccagg

SEQ ID NO: 11959 - DNA, 23 bp, Artificial Sequence
  Synthetic construct
tgggagaaaactccacaccaggc

SEQ ID NO: 11960 - DNA, 23 bp, Artificial Sequence
  Synthetic construct
gggagaaaactccacaccaggcg

SEQ ID NO: 11961 - DNA, 23 bp, Artificial Sequence
  Synthetic construct
ggagaaaactccacaccaggcga

SEQ ID NO: 11962 - DNA, 23 bp, Artificial Sequence
  Synthetic construct
gagaaaactccacaccaggcgat

SEQ ID NO: 11963 - DNA, 23 bp, Artificial Sequence
  Synthetic construct
agaaaactccacaccaggcgatc

SEQ ID NO: 11964 - DNA, 23 bp, Artificial Sequence
  Synthetic construct
gaaaactccacaccaggcgatcg

SEQ ID NO: 11965 - DNA, 23 bp, Artificial Sequence
  Synthetic construct
aaaactccacaccaggcgatcgg

SEQ ID NO: 11966 - DNA, 23 bp, Artificial Sequence
  Synthetic construct
aaactccacaccaggcgatcgga

SEQ ID NO: 11967 - DNA, 23 bp, Artificial Sequence
  Synthetic construct
aactccacaccaggcgatcggag

SEQ ID NO: 11968 - DNA, 23 bp, Artificial Sequence
  Synthetic construct
actccacaccaggcgatcggaga

SEQ ID NO: 11969 - DNA, 23 bp, Artificial Sequence
  Synthetic construct
ctccacaccaggcgatcggagat

SEQ ID NO: 11970 - DNA, 23 bp, Artificial Sequence
  Synthetic construct
tccacaccaggcgatcggagatg

SEQ ID NO: 11971 - DNA, 23 bp, Artificial Sequence
  Synthetic construct
ccacaccaggcgatcggagatgg

SEQ ID NO: 11972 - DNA, 23 bp, Artificial Sequence
  Synthetic construct
cacaccaggcgatcggagatgga

SEQ ID NO: 11973 - DNA, 23 bp, Artificial Sequence
  Synthetic construct
acaccaggcgatcggagatggaa

SEQ ID NO: 11974 - DNA, 23 bp, Artificial Sequence
  Synthetic construct
caccaggcgatcggagatggaat

SEQ ID NO: 11975 - DNA, 23 bp, Artificial Sequence
  Synthetic construct
accaggcgatcggagatggaatc

SEQ ID NO: 11976 - DNA, 23 bp, Artificial Sequence
  Synthetic construct
ccaggcgatcggagatggaatcg

SEQ ID NO: 11977 - DNA, 23 bp, Artificial Sequence
  Synthetic construct
caggcgatcggagatggaatcgg

SEQ ID NO: 11978 - DNA, 23 bp, Artificial Sequence
  Synthetic construct
aggcgatcggagatggaatcgga

SEQ ID NO: 11979 - DNA, 23 bp, Artificial Sequence
  Synthetic construct
ggcgatcggagatggaatcggat

SEQ ID NO: 11980 - DNA, 23 bp, Artificial Sequence
  Synthetic construct
gcgatcggagatggaatcggatg

SEQ ID NO: 11981 - DNA, 23 bp, Artificial Sequence
  Synthetic construct
cgatcggagatggaatcggatgc

SEQ ID NO: 11982 - DNA, 23 bp, Artificial Sequence
  Synthetic construct
gatcggagatggaatcggatgca

SEQ ID NO: 11983 - DNA, 23 bp, Artificial Sequence
  Synthetic construct
atcggagatggaatcggatgcag

SEQ ID NO: 11984 - DNA, 23 bp, Artificial Sequence
  Synthetic construct
tcggagatggaatcggatgcaga

SEQ ID NO: 11985 - DNA, 23 bp, Artificial Sequence
  Synthetic construct
cggagatggaatcggatgcagac

SEQ ID NO: 11986 - DNA, 23 bp, Artificial Sequence
  Synthetic construct
ggagatggaatcggatgcagacg

SEQ ID NO: 11987 - DNA, 23 bp, Artificial Sequence
  Synthetic construct
gagatggaatcggatgcagacga

SEQ ID NO: 11988 - DNA, 23 bp, Artificial Sequence
  Synthetic construct
agatggaatcggatgcagacgat

SEQ ID NO: 11989 - DNA, 23 bp, Artificial Sequence
  Synthetic construct
gatggaatcggatgcagacgata

SEQ ID NO: 11990 - DNA, 23 bp, Artificial Sequence
  Synthetic construct
atggaatcggatgcagacgataa

SEQ ID NO: 11991 - DNA, 23 bp, Artificial Sequence
  Synthetic construct
tggaatcggatgcagacgataag

SEQ ID NO: 11992 - DNA, 23 bp, Artificial Sequence
  Synthetic construct
ggaatcggatgcagacgataagt

SEQ ID NO: 11993 - DNA, 23 bp, Artificial Sequence
  Synthetic construct
gaatcggatgcagacgataagtc

SEQ ID NO: 11994 - DNA, 23 bp, Artificial Sequence
  Synthetic construct
aatcggatgcagacgataagtct

SEQ ID NO: 11995 - DNA, 23 bp, Artificial Sequence
  Synthetic construct
atcggatgcagacgataagtcta

SEQ ID NO: 11996 - DNA, 23 bp, Artificial Sequence
  Synthetic construct
tcggatgcagacgataagtctat

SEQ ID NO: 11997 - DNA, 23 bp, Artificial Sequence
  Synthetic construct
cggatgcagacgataagtctatc

SEQ ID NO: 11998 - DNA, 23 bp, Artificial Sequence
  Synthetic construct
ggatgcagacgataagtctatcg

SEQ ID NO: 11999 - DNA, 23 bp, Artificial Sequence
  Synthetic construct
gatgcagacgataagtctatcgt

SEQ ID NO: 12000 - DNA, 23 bp, Artificial Sequence
  Synthetic construct
atgcagacgataagtctatcgtc

SEQ ID NO: 12001 - DNA, 23 bp, Artificial Sequence
  Synthetic construct
tgcagacgataagtctatcgtcg

SEQ ID NO: 12002 - DNA, 23 bp, Artificial Sequence
  Synthetic construct
gcagacgataagtctatcgtcgc

SEQ ID NO: 12003 - DNA, 23 bp, Artificial Sequence
  Synthetic construct
cagacgataagtctatcgtcgca

SEQ ID NO: 12004 - DNA, 23 bp, Artificial Sequence
  Synthetic construct
agacgataagtctatcgtcgcaa

SEQ ID NO: 12005 - DNA, 23 bp, Artificial Sequence
  Synthetic construct
gacgataagtctatcgtcgcaag

SEQ ID NO: 12006 - DNA, 23 bp, Artificial Sequence
  Synthetic construct
acgataagtctatcgtcgcaagc

SEQ ID NO: 12007 - DNA, 23 bp, Artificial Sequence
  Synthetic construct
cgataagtctatcgtcgcaagcg

SEQ ID NO: 12008 - DNA, 23 bp, Artificial Sequence
  Synthetic construct
gataagtctatcgtcgcaagcga

SEQ ID NO: 12009 - DNA, 23 bp, Artificial Sequence
  Synthetic construct
ataagtctatcgtcgcaagcgaa

SEQ ID NO: 12010 - DNA, 23 bp, Artificial Sequence
  Synthetic construct
taagtctatcgtcgcaagcgaac

SEQ ID NO: 12011 - DNA, 23 bp, Artificial Sequence
  Synthetic construct
aagtctatcgtcgcaagcgaacc

SEQ ID NO: 12012 - DNA, 23 bp, Artificial Sequence
  Synthetic construct
agtctatcgtcgcaagcgaacca

SEQ ID NO: 12013 - DNA, 23 bp, Artificial Sequence
  Synthetic construct
gtctatcgtcgcaagcgaaccat

SEQ ID NO: 12014 - DNA, 23 bp, Artificial Sequence
  Synthetic construct
tctatcgtcgcaagcgaaccatc

SEQ ID NO: 12015 - DNA, 23 bp, Artificial Sequence
  Synthetic construct
ctatcgtcgcaagcgaaccatct

SEQ ID NO: 12016 - DNA, 23 bp, Artificial Sequence
  Synthetic construct
tatcgtcgcaagcgaaccatcta

SEQ ID NO: 12017 - DNA, 23 bp, Artificial Sequence
  Synthetic construct
atcgtcgcaagcgaaccatctac

SEQ ID NO: 12018 - DNA, 23 bp, Artificial Sequence
  Synthetic construct
tcgtcgcaagcgaaccatctacg

SEQ ID NO: 12019 - DNA, 23 bp, Artificial Sequence
  Synthetic construct
cgtcgcaagcgaaccatctacgc

SEQ ID NO: 12020 - DNA, 23 bp, Artificial Sequence
  Synthetic construct
gtcgcaagcgaaccatctacgct

SEQ ID NO: 12021 - DNA, 23 bp, Artificial Sequence
  Synthetic construct
tcgcaagcgaaccatctacgctg

SEQ ID NO: 12022 - DNA, 23 bp, Artificial Sequence
  Synthetic construct
cgcaagcgaaccatctacgctgc

SEQ ID NO: 12023 - DNA, 23 bp, Artificial Sequence
  Synthetic construct
gcaagcgaaccatctacgctgcc

SEQ ID NO: 12024 - DNA, 23 bp, Artificial Sequence
  Synthetic construct
caagcgaaccatctacgctgccc

SEQ ID NO: 12025 - DNA, 23 bp, Artificial Sequence
  Synthetic construct
aagcgaaccatctacgctgccct

SEQ ID NO: 12026 - DNA, 23 bp, Artificial Sequence
  Synthetic construct
agcgaaccatctacgctgccctg

SEQ ID NO: 12027 - DNA, 23 bp, Artificial Sequence
  Synthetic construct
gcgaaccatctacgctgccctgc

SEQ ID NO: 12028 - DNA, 23 bp, Artificial Sequence
  Synthetic construct
cgaaccatctacgctgccctgct

SEQ ID NO: 12029 - DNA, 23 bp, Artificial Sequence
  Synthetic construct
gaaccatctacgctgccctgctg

SEQ ID NO: 12030 - DNA, 23 bp, Artificial Sequence
  Synthetic construct
aaccatctacgctgccctgctga

SEQ ID NO: 12031 - DNA, 23 bp, Artificial Sequence
  Synthetic construct
accatctacgctgccctgctgag

SEQ ID NO: 12032 - DNA, 23 bp, Artificial Sequence
  Synthetic construct
ccatctacgctgccctgctgagc

SEQ ID NO: 12033 - DNA, 23 bp, Artificial Sequence
  Synthetic construct
catctacgctgccctgctgagcc

SEQ ID NO: 12034 - DNA, 23 bp, Artificial Sequence
  Synthetic construct
atctacgctgccctgctgagcca

SEQ ID NO: 12035 - DNA, 23 bp, Artificial Sequence
  Synthetic construct
tctacgctgccctgctgagccag

SEQ ID NO: 12036 - DNA, 23 bp, Artificial Sequence
  Synthetic construct
ctacgctgccctgctgagccaga

SEQ ID NO: 12037 - DNA, 23 bp, Artificial Sequence
  Synthetic construct
tacgctgccctgctgagccagac

SEQ ID NO: 12038 - DNA, 23 bp, Artificial Sequence
  Synthetic construct
acgctgccctgctgagccagacg

SEQ ID NO: 12039 - DNA, 23 bp, Artificial Sequence
  Synthetic construct
cgctgccctgctgagccagacgc

SEQ ID NO: 12040 - DNA, 23 bp, Artificial Sequence
  Synthetic construct
gctgccctgctgagccagacgct

SEQ ID NO: 12041 - DNA, 23 bp, Artificial Sequence
  Synthetic construct
ctgccctgctgagccagacgctg

SEQ ID NO: 12042 - DNA, 23 bp, Artificial Sequence
  Synthetic construct
tgccctgctgagccagacgctgg

SEQ ID NO: 12043 - DNA, 23 bp, Artificial Sequence
  Synthetic construct
gccctgctgagccagacgctggt

SEQ ID NO: 12044 - DNA, 23 bp, Artificial Sequence
  Synthetic construct
ccctgctgagccagacgctggtt

SEQ ID NO: 12045 - DNA, 23 bp, Artificial Sequence
  Synthetic construct
cctgctgagccagacgctggttg

SEQ ID NO: 12046 - DNA, 23 bp, Artificial Sequence
  Synthetic construct
ctgctgagccagacgctggttga

SEQ ID NO: 12047 - DNA, 23 bp, Artificial Sequence
  Synthetic construct
tgctgagccagacgctggttgat

SEQ ID NO: 12048 - DNA, 23 bp, Artificial Sequence
  Synthetic construct
gctgagccagacgctggttgatc

SEQ ID NO: 12049 - DNA, 23 bp, Artificial Sequence
  Synthetic construct
ctgagccagacgctggttgatcg

SEQ ID NO: 12050 - DNA, 23 bp, Artificial Sequence
  Synthetic construct
tgagccagacgctggttgatcga

SEQ ID NO: 12051 - DNA, 23 bp, Artificial Sequence
  Synthetic construct
gagccagacgctggttgatcgat

SEQ ID NO: 12052 - DNA, 23 bp, Artificial Sequence
  Synthetic construct
agccagacgctggttgatcgatt

SEQ ID NO: 12053 - DNA, 23 bp, Artificial Sequence
  Synthetic construct
gccagacgctggttgatcgattg

SEQ ID NO: 12054 - DNA, 23 bp, Artificial Sequence
  Synthetic construct
ccagacgctggttgatcgattga

SEQ ID NO: 12055 - DNA, 23 bp, Artificial Sequence
  Synthetic construct
cagacgctggttgatcgattgat

SEQ ID NO: 12056 - DNA, 23 bp, Artificial Sequence
  Synthetic construct
agacgctggttgatcgattgatc

SEQ ID NO: 12057 - DNA, 23 bp, Artificial Sequence
  Synthetic construct
gacgctggttgatcgattgatca

SEQ ID NO: 12058 - DNA, 23 bp, Artificial Sequence
  Synthetic construct
acgctggttgatcgattgatcat

SEQ ID NO: 12059 - DNA, 23 bp, Artificial Sequence
  Synthetic construct
cgctggttgatcgattgatcatt

SEQ ID NO: 12060 - DNA, 23 bp, Artificial Sequence
  Synthetic construct
gctggttgatcgattgatcattc

SEQ ID NO: 12061 - DNA, 23 bp, Artificial Sequence
  Synthetic construct
ctggttgatcgattgatcattca

SEQ ID NO: 12062 - DNA, 23 bp, Artificial Sequence
  Synthetic construct
tggttgatcgattgatcattcag

SEQ ID NO: 12063 - DNA, 23 bp, Artificial Sequence
  Synthetic construct
ggttgatcgattgatcattcagg

SEQ ID NO: 12064 - DNA, 23 bp, Artificial Sequence
  Synthetic construct
gttgatcgattgatcattcaggt

SEQ ID NO: 12065 - DNA, 23 bp, Artificial Sequence
  Synthetic construct
ttgatcgattgatcattcaggtc

SEQ ID NO: 12066 - DNA, 23 bp, Artificial Sequence
  Synthetic construct
tgatcgattgatcattcaggtct

SEQ ID NO: 12067 - DNA, 23 bp, Artificial Sequence
  Synthetic construct
gatcgattgatcattcaggtcta

SEQ ID NO: 12068 - DNA, 23 bp, Artificial Sequence
  Synthetic construct
atcgattgatcattcaggtctat

SEQ ID NO: 12069 - DNA, 23 bp, Artificial Sequence
  Synthetic construct
tcgattgatcattcaggtctata

SEQ ID NO: 12070 - DNA, 23 bp, Artificial Sequence
  Synthetic construct
cgattgatcattcaggtctatac

SEQ ID NO: 12071 - DNA, 23 bp, Artificial Sequence
  Synthetic construct
gattgatcattcaggtctatacc

SEQ ID NO: 12072 - DNA, 23 bp, Artificial Sequence
  Synthetic construct
attgatcattcaggtctatacca

SEQ ID NO: 12073 - DNA, 23 bp, Artificial Sequence
  Synthetic construct
ttgatcattcaggtctataccaa

SEQ ID NO: 12074 - DNA, 23 bp, Artificial Sequence
  Synthetic construct
tgatcattcaggtctataccaac

SEQ ID NO: 12075 - DNA, 23 bp, Artificial Sequence
  Synthetic construct
gatcattcaggtctataccaacg

SEQ ID NO: 12076 - DNA, 23 bp, Artificial Sequence
  Synthetic construct
atcattcaggtctataccaacgg

SEQ ID NO: 12077 - DNA, 23 bp, Artificial Sequence
  Synthetic construct
tcattcaggtctataccaacgga

SEQ ID NO: 12078 - DNA, 23 bp, Artificial Sequence
  Synthetic construct
cattcaggtctataccaacggat

SEQ ID NO: 12079 - DNA, 23 bp, Artificial Sequence
  Synthetic construct
attcaggtctataccaacggatt

SEQ ID NO: 12080 - DNA, 23 bp, Artificial Sequence
  Synthetic construct
ttcaggtctataccaacggattt

SEQ ID NO: 12081 - DNA, 23 bp, Artificial Sequence
  Synthetic construct
tcaggtctataccaacggatttg

SEQ ID NO: 12082 - DNA, 23 bp, Artificial Sequence
  Synthetic construct
caggtctataccaacggatttga

SEQ ID NO: 12083 - DNA, 23 bp, Artificial Sequence
  Synthetic construct
aggtctataccaacggatttgag

SEQ ID NO: 12084 - DNA, 23 bp, Artificial Sequence
  Synthetic construct
ggtctataccaacggatttgagc

SEQ ID NO: 12085 - DNA, 23 bp, Artificial Sequence
  Synthetic construct
gtctataccaacggatttgagcc

SEQ ID NO: 12086 - DNA, 23 bp, Artificial Sequence
  Synthetic construct
tctataccaacggatttgagccg

SEQ ID NO: 12087 - DNA, 23 bp, Artificial Sequence
  Synthetic construct
ctataccaacggatttgagccgg

SEQ ID NO: 12088 - DNA, 23 bp, Artificial Sequence
  Synthetic construct
tataccaacggatttgagccggc

SEQ ID NO: 12089 - DNA, 23 bp, Artificial Sequence
  Synthetic construct
ataccaacggatttgagccggcg

SEQ ID NO: 12090 - DNA, 23 bp, Artificial Sequence
  Synthetic construct
taccaacggatttgagccggcgt

SEQ ID NO: 12091 - DNA, 23 bp, Artificial Sequence
  Synthetic construct
accaacggatttgagccggcgtc

SEQ ID NO: 12092 - DNA, 23 bp, Artificial Sequence
  Synthetic construct
ccaacggatttgagccggcgtct

SEQ ID NO: 12093 - DNA, 23 bp, Artificial Sequence
  Synthetic construct
caacggatttgagccggcgtctg

SEQ ID NO: 12094 - DNA, 23 bp, Artificial Sequence
  Synthetic construct
aacggatttgagccggcgtctga

SEQ ID NO: 12095 - DNA, 23 bp, Artificial Sequence
  Synthetic construct
acggatttgagccggcgtctgat

SEQ ID NO: 12096 - DNA, 23 bp, Artificial Sequence
  Synthetic construct
cggatttgagccggcgtctgatg

SEQ ID NO: 12097 - DNA, 23 bp, Artificial Sequence
  Synthetic construct
ggatttgagccggcgtctgatga

SEQ ID NO: 12098 - DNA, 23 bp, Artificial Sequence
  Synthetic construct
gatttgagccggcgtctgatgaa

SEQ ID NO: 12099 - DNA, 23 bp, Artificial Sequence
  Synthetic construct
atttgagccggcgtctgatgaaa

SEQ ID NO: 12100 - DNA, 23 bp, Artificial Sequence
  Synthetic construct
tttgagccggcgtctgatgaaag

SEQ ID NO: 12101 - DNA, 23 bp, Artificial Sequence
  Synthetic construct
ttgagccggcgtctgatgaaagc

SEQ ID NO: 12102 - DNA, 23 bp, Artificial Sequence
  Synthetic construct
tgagccggcgtctgatgaaagca

SEQ ID NO: 12103 - DNA, 23 bp, Artificial Sequence
  Synthetic construct
gagccggcgtctgatgaaagcac

SEQ ID NO: 12104 - DNA, 23 bp, Artificial Sequence
  Synthetic construct
agccggcgtctgatgaaagcacc

SEQ ID NO: 12105 - DNA, 23 bp, Artificial Sequence
  Synthetic construct
gccggcgtctgatgaaagcaccg

SEQ ID NO: 12106 - DNA, 23 bp, Artificial Sequence
  Synthetic construct
ccggcgtctgatgaaagcaccga

SEQ ID NO: 12107 - DNA, 23 bp, Artificial Sequence
  Synthetic construct
cggcgtctgatgaaagcaccgac

SEQ ID NO: 12108 - DNA, 23 bp, Artificial Sequence
  Synthetic construct
ggcgtctgatgaaagcaccgacc

SEQ ID NO: 12109 - DNA, 23 bp, Artificial Sequence
  Synthetic construct
gcgtctgatgaaagcaccgaccc

SEQ ID NO: 12110 - DNA, 23 bp, Artificial Sequence
  Synthetic construct
cgtctgatgaaagcaccgacccc

SEQ ID NO: 12111 - DNA, 23 bp, Artificial Sequence
  Synthetic construct
gtctgatgaaagcaccgacccct

SEQ ID NO: 12112 - DNA, 23 bp, Artificial Sequence
  Synthetic construct
tctgatgaaagcaccgacccctt

SEQ ID NO: 12113 - DNA, 23 bp, Artificial Sequence
  Synthetic construct
ctgatgaaagcaccgaccccttt

SEQ ID NO: 12114 - DNA, 23 bp, Artificial Sequence
  Synthetic construct
tgatgaaagcaccgacccctttc

SEQ ID NO: 12115 - DNA, 23 bp, Artificial Sequence
  Synthetic construct
gatgaaagcaccgacccctttct

SEQ ID NO: 12116 - DNA, 23 bp, Artificial Sequence
  Synthetic construct
atgaaagcaccgacccctttctg

SEQ ID NO: 12117 - DNA, 23 bp, Artificial Sequence
  Synthetic construct
tgaaagcaccgacccctttctgg

SEQ ID NO: 12118 - DNA, 23 bp, Artificial Sequence
  Synthetic construct
gaaagcaccgacccctttctgga

SEQ ID NO: 12119 - DNA, 23 bp, Artificial Sequence
  Synthetic construct
aaagcaccgacccctttctggag

SEQ ID NO: 12120 - DNA, 23 bp, Artificial Sequence
  Synthetic construct
aagcaccgacccctttctggagg

SEQ ID NO: 12121 - DNA, 23 bp, Artificial Sequence
  Synthetic construct
agcaccgacccctttctggaggt

SEQ ID NO: 12122 - DNA, 23 bp, Artificial Sequence
  Synthetic construct
gcaccgacccctttctggaggta

SEQ ID NO: 12123 - DNA, 23 bp, Artificial Sequence
  Synthetic construct
caccgacccctttctggaggtac

SEQ ID NO: 12124 - DNA, 23 bp, Artificial Sequence
  Synthetic construct
accgacccctttctggaggtaca

SEQ ID NO: 12125 - DNA, 23 bp, Artificial Sequence
  Synthetic construct
ccgacccctttctggaggtacat

SEQ ID NO: 12126 - DNA, 23 bp, Artificial Sequence
  Synthetic construct
cgacccctttctggaggtacata

SEQ ID NO: 12127 - DNA, 23 bp, Artificial Sequence
  Synthetic construct
gacccctttctggaggtacatat

SEQ ID NO: 12128 - DNA, 23 bp, Artificial Sequence
  Synthetic construct
acccctttctggaggtacatatt

SEQ ID NO: 12129 - DNA, 23 bp, Artificial Sequence
  Synthetic construct
cccctttctggaggtacatattc

SEQ ID NO: 12130 - DNA, 23 bp, Artificial Sequence
  Synthetic construct
ccctttctggaggtacatattca

SEQ ID NO: 12131 - DNA, 23 bp, Artificial Sequence
  Synthetic construct
cctttctggaggtacatattcat

SEQ ID NO: 12132 - DNA, 23 bp, Artificial Sequence
  Synthetic construct
ctttctggaggtacatattcata

SEQ ID NO: 12133 - DNA, 23 bp, Artificial Sequence
  Synthetic construct
tttctggaggtacatattcatat

SEQ ID NO: 12134 - DNA, 23 bp, Artificial Sequence
  Synthetic construct
ttctggaggtacatattcatatc

SEQ ID NO: 12135 - DNA, 23 bp, Artificial Sequence
  Synthetic construct
tctggaggtacatattcatatca

SEQ ID NO: 12136 - DNA, 23 bp, Artificial Sequence
  Synthetic construct
ctggaggtacatattcatatcag

SEQ ID NO: 12137 - DNA, 23 bp, Artificial Sequence
  Synthetic construct
tggaggtacatattcatatcagg

SEQ ID NO: 12138 - DNA, 23 bp, Artificial Sequence
  Synthetic construct
ggaggtacatattcatatcaggc

SEQ ID NO: 12139 - DNA, 23 bp, Artificial Sequence
  Synthetic construct
gaggtacatattcatatcaggct

SEQ ID NO: 12140 - DNA, 23 bp, Artificial Sequence
  Synthetic construct
aggtacatattcatatcaggctc

SEQ ID NO: 12141 - DNA, 23 bp, Artificial Sequence
  Synthetic construct
ggtacatattcatatcaggctcc

SEQ ID NO: 12142 - DNA, 23 bp, Artificial Sequence
  Synthetic construct
gtacatattcatatcaggctcct

SEQ ID NO: 12143 - DNA, 23 bp, Artificial Sequence
  Synthetic construct
tacatattcatatcaggctcctt

SEQ ID NO: 12144 - DNA, 23 bp, Artificial Sequence
  Synthetic construct
acatattcatatcaggctcctta

SEQ ID NO: 12145 - DNA, 23 bp, Artificial Sequence
  Synthetic construct
catattcatatcaggctccttac

SEQ ID NO: 12146 - DNA, 23 bp, Artificial Sequence
  Synthetic construct
atattcatatcaggctccttaca

SEQ ID NO: 12147 - DNA, 23 bp, Artificial Sequence
  Synthetic construct
tattcatatcaggctccttacag

SEQ ID NO: 12148 - DNA, 23 bp, Artificial Sequence
  Synthetic construct
attcatatcaggctccttacagg

SEQ ID NO: 12149 - DNA, 23 bp, Artificial Sequence
  Synthetic construct
ttcatatcaggctccttacaggc

SEQ ID NO: 12150 - DNA, 23 bp, Artificial Sequence
  Synthetic construct
tcatatcaggctccttacaggca

SEQ ID NO: 12151 - DNA, 23 bp, Artificial Sequence
  Synthetic construct
catatcaggctccttacaggcag

SEQ ID NO: 12152 - DNA, 23 bp, Artificial Sequence
  Synthetic construct
atatcaggctccttacaggcagc

SEQ ID NO: 12153 - DNA, 23 bp, Artificial Sequence
  Synthetic construct
tatcaggctccttacaggcagcc

SEQ ID NO: 12154 - DNA, 23 bp, Artificial Sequence
  Synthetic construct
atcaggctccttacaggcagccc

SEQ ID NO: 12155 - DNA, 23 bp, Artificial Sequence
  Synthetic construct
tcaggctccttacaggcagcccg

SEQ ID NO: 12156 - DNA, 23 bp, Artificial Sequence
  Synthetic construct
caggctccttacaggcagcccga

SEQ ID NO: 12157 - DNA, 23 bp, Artificial Sequence
  Synthetic construct
aggctccttacaggcagcccgat

SEQ ID NO: 12158 - DNA, 23 bp, Artificial Sequence
  Synthetic construct
ggctccttacaggcagcccgatc

SEQ ID NO: 12159 - DNA, 23 bp, Artificial Sequence
  Synthetic construct
gctccttacaggcagcccgatct

SEQ ID NO: 12160 - DNA, 23 bp, Artificial Sequence
  Synthetic construct
ctccttacaggcagcccgatcta

SEQ ID NO: 12161 - DNA, 23 bp, Artificial Sequence
  Synthetic construct
tccttacaggcagcccgatctat

SEQ ID NO: 12162 - DNA, 23 bp, Artificial Sequence
  Synthetic construct
ccttacaggcagcccgatctatt

SEQ ID NO: 12163 - DNA, 23 bp, Artificial Sequence
  Synthetic construct
cttacaggcagcccgatctattt

SEQ ID NO: 12164 - DNA, 23 bp, Artificial Sequence
  Synthetic construct
ttacaggcagcccgatctatttt

SEQ ID NO: 12165 - DNA, 23 bp, Artificial Sequence
  Synthetic construct
tacaggcagcccgatctatttta

SEQ ID NO: 12166 - DNA, 23 bp, Artificial Sequence
  Synthetic construct
acaggcagcccgatctattttat

SEQ ID NO: 12167 - DNA, 23 bp, Artificial Sequence
  Synthetic construct
caggcagcccgatctattttatt

SEQ ID NO: 12168 - DNA, 23 bp, Artificial Sequence
  Synthetic construct
aggcagcccgatctattttatta

SEQ ID NO: 12169 - DNA, 23 bp, Artificial Sequence
  Synthetic construct
ggcagcccgatctattttattat

SEQ ID NO: 12170 - DNA, 23 bp, Artificial Sequence
  Synthetic construct
gcagcccgatctattttattatt

SEQ ID NO: 12171 - DNA, 23 bp, Artificial Sequence
  Synthetic construct
cagcccgatctattttattattc

SEQ ID NO: 12172 - DNA, 23 bp, Artificial Sequence
  Synthetic construct
agcccgatctattttattattct

SEQ ID NO: 12173 - DNA, 23 bp, Artificial Sequence
  Synthetic construct
gcccgatctattttattattctt

SEQ ID NO: 12174 - DNA, 23 bp, Artificial Sequence
  Synthetic construct
cccgatctattttattattcttc

SEQ ID NO: 12175 - DNA, 23 bp, Artificial Sequence
  Synthetic construct
ccgatctattttattattcttcg

SEQ ID NO: 12176 - DNA, 23 bp, Artificial Sequence
  Synthetic construct
cgatctattttattattcttcgg

SEQ ID NO: 12177 - DNA, 23 bp, Artificial Sequence
  Synthetic construct
gatctattttattattcttcgga

SEQ ID NO: 12178 - DNA, 23 bp, Artificial Sequence
  Synthetic construct
atctattttattattcttcggaa

SEQ ID NO: 12179 - DNA, 23 bp, Artificial Sequence
  Synthetic construct
tctattttattattcttcggaac

SEQ ID NO: 12180 - DNA, 23 bp, Artificial Sequence
  Synthetic construct
ctattttattattcttcggaact

SEQ ID NO: 12181 - DNA, 23 bp, Artificial Sequence
  Synthetic construct
tattttattattcttcggaactg

SEQ ID NO: 12182 - DNA, 23 bp, Artificial Sequence
  Synthetic construct
attttattattcttcggaactgt

SEQ ID NO: 12183 - DNA, 23 bp, Artificial Sequence
  Synthetic construct
ttttattattcttcggaactgta

SEQ ID NO: 12184 - DNA, 23 bp, Artificial Sequence
  Synthetic construct
tttattattcttcggaactgtaa

SEQ ID NO: 12185 - DNA, 23 bp, Artificial Sequence
  Synthetic construct
ttattattcttcggaactgtaaa

SEQ ID NO: 12186 - DNA, 23 bp, Artificial Sequence
  Synthetic construct
tattattcttcggaactgtaaac

SEQ ID NO: 12187 - DNA, 23 bp, Artificial Sequence
  Synthetic construct
attattcttcggaactgtaaaca

SEQ ID NO: 12188 - DNA, 23 bp, Artificial Sequence
  Synthetic construct
ttattcttcggaactgtaaacac

SEQ ID NO: 12189 - DNA, 23 bp, Artificial Sequence
  Synthetic construct
tattcttcggaactgtaaacact

SEQ ID NO: 12190 - DNA, 23 bp, Artificial Sequence
  Synthetic construct
attcttcggaactgtaaacactc

SEQ ID NO: 12191 - DNA, 23 bp, Artificial Sequence
  Synthetic construct
ttcttcggaactgtaaacactcc

SEQ ID NO: 12192 - DNA, 23 bp, Artificial Sequence
  Synthetic construct
tcttcggaactgtaaacactccg

SEQ ID NO: 12193 - DNA, 23 bp, Artificial Sequence
  Synthetic construct
cttcggaactgtaaacactccgt

SEQ ID NO: 12194 - DNA, 23 bp, Artificial Sequence
  Synthetic construct
ttcggaactgtaaacactccgtt

SEQ ID NO: 12195 - DNA, 23 bp, Artificial Sequence
  Synthetic construct
tcggaactgtaaacactccgttc

SEQ ID NO: 12196 - DNA, 23 bp, Artificial Sequence
  Synthetic construct
cggaactgtaaacactccgttcc

SEQ ID NO: 12197 - DNA, 23 bp, Artificial Sequence
  Synthetic construct
ggaactgtaaacactccgttccc

SEQ ID NO: 12198 - DNA, 23 bp, Artificial Sequence
  Synthetic construct
gaactgtaaacactccgttccct

SEQ ID NO: 12199 - DNA, 23 bp, Artificial Sequence
  Synthetic construct
aactgtaaacactccgttcccta

SEQ ID NO: 12200 - DNA, 23 bp, Artificial Sequence
  Synthetic construct
actgtaaacactccgttccctac

SEQ ID NO: 12201 - DNA, 23 bp, Artificial Sequence
  Synthetic construct
ctgtaaacactccgttccctaca

SEQ ID NO: 12202 - DNA, 23 bp, Artificial Sequence
  Synthetic construct
tgtaaacactccgttccctacaa

SEQ ID NO: 12203 - DNA, 23 bp, Artificial Sequence
  Synthetic construct
gtaaacactccgttccctacaac

SEQ ID NO: 12204 - DNA, 23 bp, Artificial Sequence
  Synthetic construct
taaacactccgttccctacaacg

SEQ ID NO: 12205 - DNA, 23 bp, Artificial Sequence
  Synthetic construct
aaacactccgttccctacaacga

SEQ ID NO: 12206 - DNA, 23 bp, Artificial Sequence
  Synthetic construct
aacactccgttccctacaacgag

SEQ ID NO: 12207 - DNA, 23 bp, Artificial Sequence
  Synthetic construct
acactccgttccctacaacgagc

SEQ ID NO: 12208 - DNA, 23 bp, Artificial Sequence
  Synthetic construct
cactccgttccctacaacgagcc

SEQ ID NO: 12209 - DNA, 23 bp, Artificial Sequence
  Synthetic construct
actccgttccctacaacgagcct

SEQ ID NO: 12210 - DNA, 23 bp, Artificial Sequence
  Synthetic construct
ctccgttccctacaacgagccta

SEQ ID NO: 12211 - DNA, 23 bp, Artificial Sequence
  Synthetic construct
tccgttccctacaacgagcctaa

SEQ ID NO: 12212 - DNA, 23 bp, Artificial Sequence
  Synthetic construct
ccgttccctacaacgagcctaaa

SEQ ID NO: 12213 - DNA, 23 bp, Artificial Sequence
  Synthetic construct
cgttccctacaacgagcctaaat

SEQ ID NO: 12214 - DNA, 23 bp, Artificial Sequence
  Synthetic construct
gttccctacaacgagcctaaatt

SEQ ID NO: 12215 - DNA, 23 bp, Artificial Sequence
  Synthetic construct
ttccctacaacgagcctaaattc

SEQ ID NO: 12216 - DNA, 23 bp, Artificial Sequence
  Synthetic construct
tccctacaacgagcctaaattca

SEQ ID NO: 12217 - DNA, 23 bp, Artificial Sequence
  Synthetic construct
ccctacaacgagcctaaattcat

SEQ ID NO: 12218 - DNA, 23 bp, Artificial Sequence
  Synthetic construct
cctacaacgagcctaaattcata

SEQ ID NO: 12219 - DNA, 23 bp, Artificial Sequence
  Synthetic construct
ctacaacgagcctaaattcatat

SEQ ID NO: 12220 - DNA, 23 bp, Artificial Sequence
  Synthetic construct
tacaacgagcctaaattcatatg

SEQ ID NO: 12221 - DNA, 23 bp, Artificial Sequence
  Synthetic construct
acaacgagcctaaattcatatga

SEQ ID NO: 12222 - DNA, 23 bp, Artificial Sequence
  Synthetic construct
caacgagcctaaattcatatgac

SEQ ID NO: 12223 - DNA, 23 bp, Artificial Sequence
  Synthetic construct
aacgagcctaaattcatatgact

SEQ ID NO: 12224 - DNA, 23 bp, Artificial Sequence
  Synthetic construct
acgagcctaaattcatatgactc

SEQ ID NO: 12225 - DNA, 23 bp, Artificial Sequence
  Synthetic construct
cgagcctaaattcatatgactcg

SEQ ID NO: 12226 - DNA, 23 bp, Artificial Sequence
  Synthetic construct
gagcctaaattcatatgactcgt

SEQ ID NO: 12227 - DNA, 23 bp, Artificial Sequence
  Synthetic construct
agcctaaattcatatgactcgtt

SEQ ID NO: 12228 - DNA, 23 bp, Artificial Sequence
  Synthetic construct
gcctaaattcatatgactcgtta

SEQ ID NO: 12229 - DNA, 23 bp, Artificial Sequence
  Synthetic construct
cctaaattcatatgactcgttat

SEQ ID NO: 12230 - DNA, 23 bp, Artificial Sequence
  Synthetic construct
ctaaattcatatgactcgttata

SEQ ID NO: 12231 - DNA, 23 bp, Artificial Sequence
  Synthetic construct
taaattcatatgactcgttatag

SEQ ID NO: 12232 - DNA, 23 bp, Artificial Sequence
  Synthetic construct
aaattcatatgactcgttatagc

SEQ ID NO: 12233 - DNA, 23 bp, Artificial Sequence
  Synthetic construct
aattcatatgactcgttatagcg

SEQ ID NO: 12234 - DNA, 23 bp, Artificial Sequence
  Synthetic construct
attcatatgactcgttatagcgg

SEQ ID NO: 12235 - DNA, 23 bp, Artificial Sequence
  Synthetic construct
ttcatatgactcgttatagcgga

SEQ ID NO: 12236 - DNA, 23 bp, Artificial Sequence
  Synthetic construct
tcatatgactcgttatagcggac

SEQ ID NO: 12237 - DNA, 23 bp, Artificial Sequence
  Synthetic construct
catatgactcgttatagcggacc

SEQ ID NO: 12238 - DNA, 23 bp, Artificial Sequence
  Synthetic construct
atatgactcgttatagcggaccg

SEQ ID NO: 12239 - DNA, 23 bp, Artificial Sequence
  Synthetic construct
tatgactcgttatagcggaccgc

SEQ ID NO: 12240 - DNA, 23 bp, Artificial Sequence
  Synthetic construct
atgactcgttatagcggaccgcg

SEQ ID NO: 12241 - DNA, 23 bp, Artificial Sequence
  Synthetic construct
tgactcgttatagcggaccgcgt

SEQ ID NO: 12242 - DNA, 23 bp, Artificial Sequence
  Synthetic construct
gactcgttatagcggaccgcgtg

SEQ ID NO: 12243 - DNA, 23 bp, Artificial Sequence
  Synthetic construct
actcgttatagcggaccgcgtgt

SEQ ID NO: 12244 - DNA, 23 bp, Artificial Sequence
  Synthetic construct
ctcgttatagcggaccgcgtgtc

SEQ ID NO: 12245 - DNA, 23 bp, Artificial Sequence
  Synthetic construct
tcgttatagcggaccgcgtgtct

SEQ ID NO: 12246 - DNA, 23 bp, Artificial Sequence
  Synthetic construct
cgttatagcggaccgcgtgtctg

SEQ ID NO: 12247 - DNA, 23 bp, Artificial Sequence
  Synthetic construct
gttatagcggaccgcgtgtctga

SEQ ID NO: 12248 - DNA, 23 bp, Artificial Sequence
  Synthetic construct
ttatagcggaccgcgtgtctgat

SEQ ID NO: 12249 - DNA, 23 bp, Artificial Sequence
  Synthetic construct
tatagcggaccgcgtgtctgatc

SEQ ID NO: 12250 - DNA, 23 bp, Artificial Sequence
  Synthetic construct
atagcggaccgcgtgtctgatcc

SEQ ID NO: 12251 - DNA, 23 bp, Artificial Sequence
  Synthetic construct
tagcggaccgcgtgtctgatcca

SEQ ID NO: 12252 - DNA, 23 bp, Artificial Sequence
  Synthetic construct
agcggaccgcgtgtctgatccac

SEQ ID NO: 12253 - DNA, 23 bp, Artificial Sequence
  Synthetic construct
gcggaccgcgtgtctgatccacg

SEQ ID NO: 12254 - DNA, 23 bp, Artificial Sequence
  Synthetic construct
cggaccgcgtgtctgatccacgg

SEQ ID NO: 12255 - DNA, 23 bp, Artificial Sequence
  Synthetic construct
ggaccgcgtgtctgatccacggc

SEQ ID NO: 12256 - DNA, 23 bp, Artificial Sequence
  Synthetic construct
gaccgcgtgtctgatccacggcg

SEQ ID NO: 12257 - DNA, 23 bp, Artificial Sequence
  Synthetic construct
accgcgtgtctgatccacggcgc

SEQ ID NO: 12258 - DNA, 23 bp, Artificial Sequence
  Synthetic construct
ccgcgtgtctgatccacggcgca

SEQ ID NO: 12259 - DNA, 23 bp, Artificial Sequence
  Synthetic construct
cgcgtgtctgatccacggcgcac

SEQ ID NO: 12260 - DNA, 23 bp, Artificial Sequence
  Synthetic construct
gcgtgtctgatccacggcgcaca

SEQ ID NO: 12261 - DNA, 23 bp, Artificial Sequence
  Synthetic construct
cgtgtctgatccacggcgcacat

SEQ ID NO: 12262 - DNA, 23 bp, Artificial Sequence
  Synthetic construct
gtgtctgatccacggcgcacatt

SEQ ID NO: 12263 - DNA, 23 bp, Artificial Sequence
  Synthetic construct
tgtctgatccacggcgcacattg

SEQ ID NO: 12264 - DNA, 23 bp, Artificial Sequence
  Synthetic construct
gtctgatccacggcgcacattgg

SEQ ID NO: 12265 - DNA, 23 bp, Artificial Sequence
  Synthetic construct
tctgatccacggcgcacattggt

SEQ ID NO: 12266 - DNA, 23 bp, Artificial Sequence
  Synthetic construct
ctgatccacggcgcacattggtc

SEQ ID NO: 12267 - DNA, 23 bp, Artificial Sequence
  Synthetic construct
tgatccacggcgcacattggtct

SEQ ID NO: 12268 - DNA, 23 bp, Artificial Sequence
  Synthetic construct
gatccacggcgcacattggtctc

SEQ ID NO: 12269 - DNA, 23 bp, Artificial Sequence
  Synthetic construct
atccacggcgcacattggtctcg

SEQ ID NO: 12270 - DNA, 23 bp, Artificial Sequence
  Synthetic construct
tccacggcgcacattggtctcgg

SEQ ID NO: 12271 - DNA, 23 bp, Artificial Sequence
  Synthetic construct
ccacggcgcacattggtctcgga

SEQ ID NO: 12272 - DNA, 23 bp, Artificial Sequence
  Synthetic construct
cacggcgcacattggtctcggac

SEQ ID NO: 12273 - DNA, 23 bp, Artificial Sequence
  Synthetic construct
acggcgcacattggtctcggacc

SEQ ID NO: 12274 - DNA, 23 bp, Artificial Sequence
  Synthetic construct
cggcgcacattggtctcggacca

SEQ ID NO: 12275 - DNA, 23 bp, Artificial Sequence
  Synthetic construct
ggcgcacattggtctcggaccaa

SEQ ID NO: 12276 - DNA, 23 bp, Artificial Sequence
  Synthetic construct
gcgcacattggtctcggaccaat

SEQ ID NO: 12277 - DNA, 23 bp, Artificial Sequence
  Synthetic construct
cgcacattggtctcggaccaata

SEQ ID NO: 12278 - DNA, 23 bp, Artificial Sequence
  Synthetic construct
gcacattggtctcggaccaatag

SEQ ID NO: 12279 - DNA, 23 bp, Artificial Sequence
  Synthetic construct
cacattggtctcggaccaataga

SEQ ID NO: 12280 - DNA, 23 bp, Artificial Sequence
  Synthetic construct
acattggtctcggaccaatagag

SEQ ID NO: 12281 - DNA, 23 bp, Artificial Sequence
  Synthetic construct
cattggtctcggaccaatagagc

SEQ ID NO: 12282 - DNA, 23 bp, Artificial Sequence
  Synthetic construct
attggtctcggaccaatagagcc

SEQ ID NO: 12283 - DNA, 23 bp, Artificial Sequence
  Synthetic construct
ttggtctcggaccaatagagccg

SEQ ID NO: 12284 - DNA, 23 bp, Artificial Sequence
  Synthetic construct
tggtctcggaccaatagagccgc

SEQ ID NO: 12285 - DNA, 23 bp, Artificial Sequence
  Synthetic construct
ggtctcggaccaatagagccgct

SEQ ID NO: 12286 - DNA, 23 bp, Artificial Sequence
  Synthetic construct
gtctcggaccaatagagccgctc

SEQ ID NO: 12287 - DNA, 23 bp, Artificial Sequence
  Synthetic construct
tctcggaccaatagagccgctct

SEQ ID NO: 12288 - DNA, 23 bp, Artificial Sequence
  Synthetic construct
ctcggaccaatagagccgctctc

SEQ ID NO: 12289 - DNA, 23 bp, Artificial Sequence
  Synthetic construct
tcggaccaatagagccgctctca

SEQ ID NO: 12290 - DNA, 23 bp, Artificial Sequence
  Synthetic construct
cggaccaatagagccgctctcag

SEQ ID NO: 12291 - DNA, 23 bp, Artificial Sequence
  Synthetic construct
ggaccaatagagccgctctcaga

SEQ ID NO: 12292 - DNA, 23 bp, Artificial Sequence
  Synthetic construct
gaccaatagagccgctctcagag

SEQ ID NO: 12293 - DNA, 23 bp, Artificial Sequence
  Synthetic construct
accaatagagccgctctcagagc

SEQ ID NO: 12294 - DNA, 23 bp, Artificial Sequence
  Synthetic construct
ccaatagagccgctctcagagcg

SEQ ID NO: 12295 - DNA, 23 bp, Artificial Sequence
  Synthetic construct
caatagagccgctctcagagcgc

SEQ ID NO: 12296 - DNA, 23 bp, Artificial Sequence
  Synthetic construct
aatagagccgctctcagagcgcg

SEQ ID NO: 12297 - DNA, 23 bp, Artificial Sequence
  Synthetic construct
atagagccgctctcagagcgcgg

SEQ ID NO: 12298 - DNA, 23 bp, Artificial Sequence
  Synthetic construct
tagagccgctctcagagcgcggg

SEQ ID NO: 12299 - DNA, 23 bp, Artificial Sequence
  Synthetic construct
agagccgctctcagagcgcgggg

SEQ ID NO: 12300 - DNA, 23 bp, Artificial Sequence
  Synthetic construct
gagccgctctcagagcgcggggg

SEQ ID NO: 12301 - DNA, 23 bp, Artificial Sequence
  Synthetic construct
agccgctctcagagcgcgggggg

SEQ ID NO: 12302 - DNA, 23 bp, Artificial Sequence
  Synthetic construct
gccgctctcagagcgcggggggt

SEQ ID NO: 12303 - DNA, 23 bp, Artificial Sequence
  Synthetic construct
ccgctctcagagcgcggggggta

SEQ ID NO: 12304 - DNA, 23 bp, Artificial Sequence
  Synthetic construct
cgctctcagagcgcggggggtaa

SEQ ID NO: 12305 - DNA, 23 bp, Artificial Sequence
  Synthetic construct
gctctcagagcgcggggggtaac

SEQ ID NO: 12306 - DNA, 23 bp, Artificial Sequence
  Synthetic construct
ctctcagagcgcggggggtaacg

SEQ ID NO: 12307 - DNA, 23 bp, Artificial Sequence
  Synthetic construct
tctcagagcgcggggggtaacgg

SEQ ID NO: 12308 - DNA, 23 bp, Artificial Sequence
  Synthetic construct
ctcagagcgcggggggtaacggt

SEQ ID NO: 12309 - DNA, 23 bp, Artificial Sequence
  Synthetic construct
tcagagcgcggggggtaacggtt

SEQ ID NO: 12310 - DNA, 23 bp, Artificial Sequence
  Synthetic construct
cagagcgcggggggtaacggttg

SEQ ID NO: 12311 - DNA, 23 bp, Artificial Sequence
  Synthetic construct
agagcgcggggggtaacggttgc

SEQ ID NO: 12312 - DNA, 23 bp, Artificial Sequence
  Synthetic construct
gagcgcggggggtaacggttgct

SEQ ID NO: 12313 - DNA, 23 bp, Artificial Sequence
  Synthetic construct
agcgcggggggtaacggttgctt

SEQ ID NO: 12314 - DNA, 23 bp, Artificial Sequence
  Synthetic construct
gcgcggggggtaacggttgcttg

SEQ ID NO: 12315 - DNA, 23 bp, Artificial Sequence
  Synthetic construct
cgcggggggtaacggttgcttgt

SEQ ID NO: 12316 - DNA, 23 bp, Artificial Sequence
  Synthetic construct
gcggggggtaacggttgcttgtt

SEQ ID NO: 12317 - DNA, 23 bp, Artificial Sequence
  Synthetic construct
cggggggtaacggttgcttgttc

SEQ ID NO: 12318 - DNA, 23 bp, Artificial Sequence
  Synthetic construct
ggggggtaacggttgcttgttca

SEQ ID NO: 12319 - DNA, 23 bp, Artificial Sequence
  Synthetic construct
gggggtaacggttgcttgttcag

SEQ ID NO: 12320 - DNA, 23 bp, Artificial Sequence
  Synthetic construct
ggggtaacggttgcttgttcagc

SEQ ID NO: 12321 - DNA, 23 bp, Artificial Sequence
  Synthetic construct
gggtaacggttgcttgttcagcg

SEQ ID NO: 12322 - DNA, 23 bp, Artificial Sequence
  Synthetic construct
ggtaacggttgcttgttcagcga

SEQ ID NO: 12323 - DNA, 23 bp, Artificial Sequence
  Synthetic construct
gtaacggttgcttgttcagcgaa

SEQ ID NO: 12324 - DNA, 23 bp, Artificial Sequence
  Synthetic construct
taacggttgcttgttcagcgaac

SEQ ID NO: 12325 - DNA, 23 bp, Artificial Sequence
  Synthetic construct
aacggttgcttgttcagcgaact

SEQ ID NO: 12326 - DNA, 23 bp, Artificial Sequence
  Synthetic construct
acggttgcttgttcagcgaactt

SEQ ID NO: 12327 - DNA, 23 bp, Artificial Sequence
  Synthetic construct
cggttgcttgttcagcgaacttc

SEQ ID NO: 12328 - DNA, 23 bp, Artificial Sequence
  Synthetic construct
ggttgcttgttcagcgaacttct

SEQ ID NO: 12329 - DNA, 23 bp, Artificial Sequence
  Synthetic construct
gttgcttgttcagcgaacttctt

SEQ ID NO: 12330 - DNA, 23 bp, Artificial Sequence
  Synthetic construct
ttgcttgttcagcgaacttcttg

SEQ ID NO: 12331 - DNA, 23 bp, Artificial Sequence
  Synthetic construct
tgcttgttcagcgaacttcttgt

SEQ ID NO: 12332 - DNA, 23 bp, Artificial Sequence
  Synthetic construct
gcttgttcagcgaacttcttgta

SEQ ID NO: 12333 - DNA, 23 bp, Artificial Sequence
  Synthetic construct
cttgttcagcgaacttcttgtaa

SEQ ID NO: 12334 - DNA, 23 bp, Artificial Sequence
  Synthetic construct
ttgttcagcgaacttcttgtaag

SEQ ID NO: 12335 - DNA, 23 bp, Artificial Sequence
  Synthetic construct
tgttcagcgaacttcttgtaagg

SEQ ID NO: 12336 - DNA, 23 bp, Artificial Sequence
  Synthetic construct
gttcagcgaacttcttgtaaggc

SEQ ID NO: 12337 - DNA, 23 bp, Artificial Sequence
  Synthetic construct
ttcagcgaacttcttgtaaggcg

SEQ ID NO: 12338 - DNA, 23 bp, Artificial Sequence
  Synthetic construct
tcagcgaacttcttgtaaggcgc

SEQ ID NO: 12339 - DNA, 23 bp, Artificial Sequence
  Synthetic construct
cagcgaacttcttgtaaggcgct

SEQ ID NO: 12340 - DNA, 23 bp, Artificial Sequence
  Synthetic construct
agcgaacttcttgtaaggcgctg

SEQ ID NO: 12341 - DNA, 23 bp, Artificial Sequence
  Synthetic construct
gcgaacttcttgtaaggcgctgc

SEQ ID NO: 12342 - DNA, 23 bp, Artificial Sequence
  Synthetic construct
cgaacttcttgtaaggcgctgca

SEQ ID NO: 12343 - DNA, 23 bp, Artificial Sequence
  Synthetic construct
gaacttcttgtaaggcgctgcat

SEQ ID NO: 12344 - DNA, 23 bp, Artificial Sequence
  Synthetic construct
aacttcttgtaaggcgctgcatc

SEQ ID NO: 12345 - DNA, 23 bp, Artificial Sequence
  Synthetic construct
acttcttgtaaggcgctgcatcc

SEQ ID NO: 12346 - DNA, 23 bp, Artificial Sequence
  Synthetic construct
cttcttgtaaggcgctgcatcct

SEQ ID NO: 12347 - DNA, 23 bp, Artificial Sequence
  Synthetic construct
ttcttgtaaggcgctgcatcctg

SEQ ID NO: 12348 - DNA, 23 bp, Artificial Sequence
  Synthetic construct
tcttgtaaggcgctgcatcctgc

SEQ ID NO: 12349 - DNA, 23 bp, Artificial Sequence
  Synthetic construct
cttgtaaggcgctgcatcctgca

SEQ ID NO: 12350 - DNA, 23 bp, Artificial Sequence
  Synthetic construct
ttgtaaggcgctgcatcctgcaa

SEQ ID NO: 12351 - DNA, 23 bp, Artificial Sequence
  Synthetic construct
tgtaaggcgctgcatcctgcaac

SEQ ID NO: 12352 - DNA, 23 bp, Artificial Sequence
  Synthetic construct
gtaaggcgctgcatcctgcaact

SEQ ID NO: 12353 - DNA, 23 bp, Artificial Sequence
  Synthetic construct
taaggcgctgcatcctgcaactt

SEQ ID NO: 12354 - DNA, 23 bp, Artificial Sequence
  Synthetic construct
aaggcgctgcatcctgcaacttg

SEQ ID NO: 12355 - DNA, 23 bp, Artificial Sequence
  Synthetic construct
aggcgctgcatcctgcaacttgt

SEQ ID NO: 12356 - DNA, 23 bp, Artificial Sequence
  Synthetic construct
ggcgctgcatcctgcaacttgtg

SEQ ID NO: 12357 - DNA, 23 bp, Artificial Sequence
  Synthetic construct
gcgctgcatcctgcaacttgtgc

SEQ ID NO: 12358 - DNA, 23 bp, Artificial Sequence
  Synthetic construct
cgctgcatcctgcaacttgtgcc

SEQ ID NO: 12359 - DNA, 23 bp, Artificial Sequence
  Synthetic construct
gctgcatcctgcaacttgtgccc

SEQ ID NO: 12360 - DNA, 23 bp, Artificial Sequence
  Synthetic construct
ctgcatcctgcaacttgtgcccc

SEQ ID NO: 12361 - DNA, 23 bp, Artificial Sequence
  Synthetic construct
tgcatcctgcaacttgtgcccca

SEQ ID NO: 12362 - DNA, 23 bp, Artificial Sequence
  Synthetic construct
gcatcctgcaacttgtgccccat

SEQ ID NO: 12363 - DNA, 23 bp, Artificial Sequence
  Synthetic construct
catcctgcaacttgtgccccata

SEQ ID NO: 12364 - DNA, 23 bp, Artificial Sequence
  Synthetic construct
atcctgcaacttgtgccccatag

SEQ ID NO: 12365 - DNA, 23 bp, Artificial Sequence
  Synthetic construct
tcctgcaacttgtgccccatagg

SEQ ID NO: 12366 - DNA, 23 bp, Artificial Sequence
  Synthetic construct
cctgcaacttgtgccccatagga

SEQ ID NO: 12367 - DNA, 23 bp, Artificial Sequence
  Synthetic construct
ctgcaacttgtgccccataggag

SEQ ID NO: 12368 - DNA, 23 bp, Artificial Sequence
  Synthetic construct
tgcaacttgtgccccataggagc

SEQ ID NO: 12369 - DNA, 23 bp, Artificial Sequence
  Synthetic construct
gcaacttgtgccccataggagca

SEQ ID NO: 12370 - DNA, 23 bp, Artificial Sequence
  Synthetic construct
caacttgtgccccataggagcac

SEQ ID NO: 12371 - DNA, 23 bp, Artificial Sequence
  Synthetic construct
aacttgtgccccataggagcacc

SEQ ID NO: 12372 - DNA, 23 bp, Artificial Sequence
  Synthetic construct
acttgtgccccataggagcaccg

SEQ ID NO: 12373 - DNA, 23 bp, Artificial Sequence
  Synthetic construct
cttgtgccccataggagcaccgt

SEQ ID NO: 12374 - DNA, 23 bp, Artificial Sequence
  Synthetic construct
ttgtgccccataggagcaccgtt

SEQ ID NO: 12375 - DNA, 23 bp, Artificial Sequence
  Synthetic construct
tgtgccccataggagcaccgttg

SEQ ID NO: 12376 - DNA, 23 bp, Artificial Sequence
  Synthetic construct
gtgccccataggagcaccgttgg

SEQ ID NO: 12377 - DNA, 23 bp, Artificial Sequence
  Synthetic construct
tgccccataggagcaccgttgga

SEQ ID NO: 12378 - DNA, 23 bp, Artificial Sequence
  Synthetic construct
gccccataggagcaccgttggag

SEQ ID NO: 12379 - DNA, 23 bp, Artificial Sequence
  Synthetic construct
ccccataggagcaccgttggaga

SEQ ID NO: 12380 - DNA, 23 bp, Artificial Sequence
  Synthetic construct
cccataggagcaccgttggagaa

SEQ ID NO: 12381 - DNA, 23 bp, Artificial Sequence
  Synthetic construct
ccataggagcaccgttggagaac

SEQ ID NO: 12382 - DNA, 23 bp, Artificial Sequence
  Synthetic construct
cataggagcaccgttggagaacg

SEQ ID NO: 12383 - DNA, 23 bp, Artificial Sequence
  Synthetic construct
ataggagcaccgttggagaacgt

SEQ ID NO: 12384 - DNA, 23 bp, Artificial Sequence
  Synthetic construct
taggagcaccgttggagaacgtg

SEQ ID NO: 12385 - DNA, 23 bp, Artificial Sequence
  Synthetic construct
aggagcaccgttggagaacgtgc

SEQ ID NO: 12386 - DNA, 23 bp, Artificial Sequence
  Synthetic construct
ggagcaccgttggagaacgtgca

SEQ ID NO: 12387 - DNA, 23 bp, Artificial Sequence
  Synthetic construct
gagcaccgttggagaacgtgcat

SEQ ID NO: 12388 - DNA, 23 bp, Artificial Sequence
  Synthetic construct
agcaccgttggagaacgtgcatt

SEQ ID NO: 12389 - DNA, 23 bp, Artificial Sequence
  Synthetic construct
gcaccgttggagaacgtgcattg

SEQ ID NO: 12390 - DNA, 23 bp, Artificial Sequence
  Synthetic construct
caccgttggagaacgtgcattgc

SEQ ID NO: 12391 - DNA, 23 bp, Artificial Sequence
  Synthetic construct
accgttggagaacgtgcattgcc

SEQ ID NO: 12392 - DNA, 23 bp, Artificial Sequence
  Synthetic construct
ccgttggagaacgtgcattgccc

SEQ ID NO: 12393 - DNA, 23 bp, Artificial Sequence
  Synthetic construct
cgttggagaacgtgcattgccca

SEQ ID NO: 12394 - DNA, 23 bp, Artificial Sequence
  Synthetic construct
gttggagaacgtgcattgcccaa

SEQ ID NO: 12395 - DNA, 23 bp, Artificial Sequence
  Synthetic construct
ttggagaacgtgcattgcccaaa

SEQ ID NO: 12396 - DNA, 23 bp, Artificial Sequence
  Synthetic construct
tggagaacgtgcattgcccaaac

SEQ ID NO: 12397 - DNA, 23 bp, Artificial Sequence
  Synthetic construct
ggagaacgtgcattgcccaaaca

SEQ ID NO: 12398 - DNA, 23 bp, Artificial Sequence
  Synthetic construct
gagaacgtgcattgcccaaacaa

SEQ ID NO: 12399 - DNA, 23 bp, Artificial Sequence
  Synthetic construct
agaacgtgcattgcccaaacaac

SEQ ID NO: 12400 - DNA, 23 bp, Artificial Sequence
  Synthetic construct
gaacgtgcattgcccaaacaacg

SEQ ID NO: 12401 - DNA, 23 bp, Artificial Sequence
  Synthetic construct
aacgtgcattgcccaaacaacga

SEQ ID NO: 12402 - DNA, 23 bp, Artificial Sequence
  Synthetic construct
acgtgcattgcccaaacaacgac

SEQ ID NO: 12403 - DNA, 23 bp, Artificial Sequence
  Synthetic construct
cgtgcattgcccaaacaacgacg

SEQ ID NO: 12404 - DNA, 23 bp, Artificial Sequence
  Synthetic construct
gtgcattgcccaaacaacgacga

SEQ ID NO: 12405 - DNA, 23 bp, Artificial Sequence
  Synthetic construct
tgcattgcccaaacaacgacgat

SEQ ID NO: 12406 - DNA, 23 bp, Artificial Sequence
  Synthetic construct
gcattgcccaaacaacgacgatc

SEQ ID NO: 12407 - DNA, 23 bp, Artificial Sequence
  Synthetic construct
cattgcccaaacaacgacgatcg

SEQ ID NO: 12408 - DNA, 23 bp, Artificial Sequence
  Synthetic construct
attgcccaaacaacgacgatcgg

SEQ ID NO: 12409 - DNA, 23 bp, Artificial Sequence
  Synthetic construct
ttgcccaaacaacgacgatcggt

SEQ ID NO: 12410 - DNA, 23 bp, Artificial Sequence
  Synthetic construct
tgcccaaacaacgacgatcggta

SEQ ID NO: 12411 - DNA, 23 bp, Artificial Sequence
  Synthetic construct
gcccaaacaacgacgatcggtag

SEQ ID NO: 12412 - DNA, 23 bp, Artificial Sequence
  Synthetic construct
cccaaacaacgacgatcggtagc

SEQ ID NO: 12413 - DNA, 23 bp, Artificial Sequence
  Synthetic construct
ccaaacaacgacgatcggtagcc

SEQ ID NO: 12414 - DNA, 23 bp, Artificial Sequence
  Synthetic construct
caaacaacgacgatcggtagcca

SEQ ID NO: 12415 - DNA, 23 bp, Artificial Sequence
  Synthetic construct
aaacaacgacgatcggtagccag

SEQ ID NO: 12416 - DNA, 23 bp, Artificial Sequence
  Synthetic construct
aacaacgacgatcggtagccaga

SEQ ID NO: 12417 - DNA, 23 bp, Artificial Sequence
  Synthetic construct
acaacgacgatcggtagccagag

SEQ ID NO: 12418 - DNA, 23 bp, Artificial Sequence
  Synthetic construct
caacgacgatcggtagccagaga

SEQ ID NO: 12419 - DNA, 23 bp, Artificial Sequence
  Synthetic construct
aacgacgatcggtagccagagag

SEQ ID NO: 12420 - DNA, 23 bp, Artificial Sequence
  Synthetic construct
acgacgatcggtagccagagagg

SEQ ID NO: 12421 - DNA, 23 bp, Artificial Sequence
  Synthetic construct
cgacgatcggtagccagagagga

SEQ ID NO: 12422 - DNA, 23 bp, Artificial Sequence
  Synthetic construct
gacgatcggtagccagagaggag

SEQ ID NO: 12423 - DNA, 23 bp, Artificial Sequence
  Synthetic construct
acgatcggtagccagagaggagg

SEQ ID NO: 12424 - DNA, 23 bp, Artificial Sequence
  Synthetic construct
cgatcggtagccagagaggaggt

SEQ ID NO: 12425 - DNA, 23 bp, Artificial Sequence
  Synthetic construct
gatcggtagccagagaggaggtt

SEQ ID NO: 12426 - DNA, 23 bp, Artificial Sequence
  Synthetic construct
atcggtagccagagaggaggttg

SEQ ID NO: 12427 - DNA, 23 bp, Artificial Sequence
  Synthetic construct
tcggtagccagagaggaggttgc

SEQ ID NO: 12428 - DNA, 23 bp, Artificial Sequence
  Synthetic construct
cggtagccagagaggaggttgcc

SEQ ID NO: 12429 - DNA, 23 bp, Artificial Sequence
  Synthetic construct
ggtagccagagaggaggttgcca

SEQ ID NO: 12430 - DNA, 23 bp, Artificial Sequence
  Synthetic construct
gtagccagagaggaggttgccaa

SEQ ID NO: 12431 - DNA, 23 bp, Artificial Sequence
  Synthetic construct
tagccagagaggaggttgccaat

SEQ ID NO: 12432 - DNA, 23 bp, Artificial Sequence
  Synthetic construct
agccagagaggaggttgccaata

SEQ ID NO: 12433 - DNA, 23 bp, Artificial Sequence
  Synthetic construct
gccagagaggaggttgccaataa

SEQ ID NO: 12434 - DNA, 23 bp, Artificial Sequence
  Synthetic construct
ccagagaggaggttgccaataag

SEQ ID NO: 12435 - DNA, 23 bp, Artificial Sequence
  Synthetic construct
cagagaggaggttgccaataagg

SEQ ID NO: 12436 - DNA, 23 bp, Artificial Sequence
  Synthetic construct
agagaggaggttgccaataaggc

SEQ ID NO: 12437 - DNA, 23 bp, Artificial Sequence
  Synthetic construct
gagaggaggttgccaataaggct

SEQ ID NO: 12438 - DNA, 23 bp, Artificial Sequence
  Synthetic construct
agaggaggttgccaataaggcta

SEQ ID NO: 12439 - DNA, 23 bp, Artificial Sequence
  Synthetic construct
gaggaggttgccaataaggctac

SEQ ID NO: 12440 - DNA, 23 bp, Artificial Sequence
  Synthetic construct
aggaggttgccaataaggctacg

SEQ ID NO: 12441 - DNA, 23 bp, Artificial Sequence
  Synthetic construct
ggaggttgccaataaggctacgg

SEQ ID NO: 12442 - DNA, 23 bp, Artificial Sequence
  Synthetic construct
gaggttgccaataaggctacgga

SEQ ID NO: 12443 - DNA, 23 bp, Artificial Sequence
  Synthetic construct
aggttgccaataaggctacggat

SEQ ID NO: 12444 - DNA, 23 bp, Artificial Sequence
  Synthetic construct
ggttgccaataaggctacggatg

SEQ ID NO: 12445 - DNA, 23 bp, Artificial Sequence
  Synthetic construct
gttgccaataaggctacggatgc

SEQ ID NO: 12446 - DNA, 23 bp, Artificial Sequence
  Synthetic construct
ttgccaataaggctacggatgct

SEQ ID NO: 12447 - DNA, 23 bp, Artificial Sequence
  Synthetic construct
tgccaataaggctacggatgctg

SEQ ID NO: 12448 - DNA, 23 bp, Artificial Sequence
  Synthetic construct
gccaataaggctacggatgctgg

SEQ ID NO: 12449 - DNA, 23 bp, Artificial Sequence
  Synthetic construct
ccaataaggctacggatgctggt

SEQ ID NO: 12450 - DNA, 23 bp, Artificial Sequence
  Synthetic construct
caataaggctacggatgctggtt

SEQ ID NO: 12451 - DNA, 23 bp, Artificial Sequence
  Synthetic construct
aataaggctacggatgctggttt

SEQ ID NO: 12452 - DNA, 23 bp, Artificial Sequence
  Synthetic construct
ataaggctacggatgctggtttg

SEQ ID NO: 12453 - DNA, 23 bp, Artificial Sequence
  Synthetic construct
taaggctacggatgctggtttgt

SEQ ID NO: 12454 - DNA, 23 bp, Artificial Sequence
  Synthetic construct
aaggctacggatgctggtttgta

SEQ ID NO: 12455 - DNA, 23 bp, Artificial Sequence
  Synthetic construct
aggctacggatgctggtttgtaa

SEQ ID NO: 12456 - DNA, 23 bp, Artificial Sequence
  Synthetic construct
ggctacggatgctggtttgtaaa

SEQ ID NO: 12457 - DNA, 23 bp, Artificial Sequence
  Synthetic construct
gctacggatgctggtttgtaaaa

SEQ ID NO: 12458 - DNA, 23 bp, Artificial Sequence
  Synthetic construct
ctacggatgctggtttgtaaaac

SEQ ID NO: 12459 - DNA, 23 bp, Artificial Sequence
  Synthetic construct
tacggatgctggtttgtaaaaca

SEQ ID NO: 12460 - DNA, 23 bp, Artificial Sequence
  Synthetic construct
acggatgctggtttgtaaaacat

SEQ ID NO: 12461 - DNA, 23 bp, Artificial Sequence
  Synthetic construct
cggatgctggtttgtaaaacatc

SEQ ID NO: 12462 - DNA, 23 bp, Artificial Sequence
  Synthetic construct
ggatgctggtttgtaaaacatcc

SEQ ID NO: 12463 - DNA, 23 bp, Artificial Sequence
  Synthetic construct
gatgctggtttgtaaaacatccg

SEQ ID NO: 12464 - DNA, 23 bp, Artificial Sequence
  Synthetic construct
atgctggtttgtaaaacatccgg

SEQ ID NO: 12465 - DNA, 23 bp, Artificial Sequence
  Synthetic construct
tgctggtttgtaaaacatccgga

SEQ ID NO: 12466 - DNA, 23 bp, Artificial Sequence
  Synthetic construct
gctggtttgtaaaacatccggat

SEQ ID NO: 12467 - DNA, 23 bp, Artificial Sequence
  Synthetic construct
ctggtttgtaaaacatccggatc

SEQ ID NO: 12468 - DNA, 23 bp, Artificial Sequence
  Synthetic construct
tggtttgtaaaacatccggatcc

SEQ ID NO: 12469 - DNA, 23 bp, Artificial Sequence
  Synthetic construct
ggtttgtaaaacatccggatccc

SEQ ID NO: 12470 - DNA, 23 bp, Artificial Sequence
  Synthetic construct
gtttgtaaaacatccggatccca

SEQ ID NO: 12471 - DNA, 23 bp, Artificial Sequence
  Synthetic construct
tttgtaaaacatccggatcccat

SEQ ID NO: 12472 - DNA, 23 bp, Artificial Sequence
  Synthetic construct
ttgtaaaacatccggatcccatg

SEQ ID NO: 12473 - DNA, 23 bp, Artificial Sequence
  Synthetic construct
tgtaaaacatccggatcccatga

SEQ ID NO: 12474 - DNA, 23 bp, Artificial Sequence
  Synthetic construct
gtaaaacatccggatcccatgac

SEQ ID NO: 12475 - DNA, 23 bp, Artificial Sequence
  Synthetic construct
taaaacatccggatcccatgaca

SEQ ID NO: 12476 - DNA, 23 bp, Artificial Sequence
  Synthetic construct
aaaacatccggatcccatgacaa

SEQ ID NO: 12477 - DNA, 23 bp, Artificial Sequence
  Synthetic construct
aaacatccggatcccatgacaag

SEQ ID NO: 12478 - DNA, 23 bp, Artificial Sequence
  Synthetic construct
aacatccggatcccatgacaagg

SEQ ID NO: 12479 - DNA, 23 bp, Artificial Sequence
  Synthetic construct
acatccggatcccatgacaagga

SEQ ID NO: 12480 - DNA, 23 bp, Artificial Sequence
  Synthetic construct
catccggatcccatgacaaggat

SEQ ID NO: 12481 - DNA, 23 bp, Artificial Sequence
  Synthetic construct
atccggatcccatgacaaggatt

SEQ ID NO: 12482 - DNA, 23 bp, Artificial Sequence
  Synthetic construct
tccggatcccatgacaaggattt

SEQ ID NO: 12483 - DNA, 23 bp, Artificial Sequence
  Synthetic construct
ccggatcccatgacaaggatttg

SEQ ID NO: 12484 - DNA, 23 bp, Artificial Sequence
  Synthetic construct
cggatcccatgacaaggatttgt

SEQ ID NO: 12485 - DNA, 23 bp, Artificial Sequence
  Synthetic construct
ggatcccatgacaaggatttgtc

SEQ ID NO: 12486 - DNA, 23 bp, Artificial Sequence
  Synthetic construct
gatcccatgacaaggatttgtca

SEQ ID NO: 12487 - DNA, 23 bp, Artificial Sequence
  Synthetic construct
atcccatgacaaggatttgtcat

SEQ ID NO: 12488 - DNA, 23 bp, Artificial Sequence
  Synthetic construct
tcccatgacaaggatttgtcatg

SEQ ID NO: 12489 - DNA, 23 bp, Artificial Sequence
  Synthetic construct
cccatgacaaggatttgtcatgt

SEQ ID NO: 12490 - DNA, 23 bp, Artificial Sequence
  Synthetic construct
ccatgacaaggatttgtcatgta

SEQ ID NO: 12491 - DNA, 23 bp, Artificial Sequence
  Synthetic construct
catgacaaggatttgtcatgtaa

SEQ ID NO: 12492 - DNA, 23 bp, Artificial Sequence
  Synthetic construct
atgacaaggatttgtcatgtaag

SEQ ID NO: 12493 - DNA, 23 bp, Artificial Sequence
  Synthetic construct
tgacaaggatttgtcatgtaaga

SEQ ID NO: 12494 - DNA, 23 bp, Artificial Sequence
  Synthetic construct
gacaaggatttgtcatgtaagaa

SEQ ID NO: 12495 - DNA, 23 bp, Artificial Sequence
  Synthetic construct
acaaggatttgtcatgtaagaaa

SEQ ID NO: 12496 - DNA, 23 bp, Artificial Sequence
  Synthetic construct
caaggatttgtcatgtaagaaac

SEQ ID NO: 12497 - DNA, 23 bp, Artificial Sequence
  Synthetic construct
aaggatttgtcatgtaagaaacc

SEQ ID NO: 12498 - DNA, 23 bp, Artificial Sequence
  Synthetic construct
aggatttgtcatgtaagaaacct

SEQ ID NO: 12499 - DNA, 23 bp, Artificial Sequence
  Synthetic construct
ggatttgtcatgtaagaaacctt

SEQ ID NO: 12500 - DNA, 23 bp, Artificial Sequence
  Synthetic construct
gatttgtcatgtaagaaaccttc

SEQ ID NO: 12501 - DNA, 23 bp, Artificial Sequence
  Synthetic construct
atttgtcatgtaagaaaccttct

SEQ ID NO: 12502 - DNA, 23 bp, Artificial Sequence
  Synthetic construct
tttgtcatgtaagaaaccttctc

SEQ ID NO: 12503 - DNA, 23 bp, Artificial Sequence
  Synthetic construct
ttgtcatgtaagaaaccttctct

SEQ ID NO: 12504 - DNA, 23 bp, Artificial Sequence
  Synthetic construct
tgtcatgtaagaaaccttctcta

SEQ ID NO: 12505 - DNA, 23 bp, Artificial Sequence
  Synthetic construct
gtcatgtaagaaaccttctctat

SEQ ID NO: 12506 - DNA, 23 bp, Artificial Sequence
  Synthetic construct
tcatgtaagaaaccttctctatt

SEQ ID NO: 12507 - DNA, 23 bp, Artificial Sequence
  Synthetic construct
catgtaagaaaccttctctattt

SEQ ID NO: 12508 - DNA, 23 bp, Artificial Sequence
  Synthetic construct
atgtaagaaaccttctctattta

SEQ ID NO: 12509 - DNA, 23 bp, Artificial Sequence
  Synthetic construct
tgtaagaaaccttctctatttat

SEQ ID NO: 12510 - DNA, 23 bp, Artificial Sequence
  Synthetic construct
gtaagaaaccttctctatttatc

SEQ ID NO: 12511 - DNA, 23 bp, Artificial Sequence
  Synthetic construct
taagaaaccttctctatttatct

SEQ ID NO: 12512 - DNA, 23 bp, Artificial Sequence
  Synthetic construct
aagaaaccttctctatttatctg

SEQ ID NO: 12513 - DNA, 23 bp, Artificial Sequence
  Synthetic construct
agaaaccttctctatttatctga

SEQ ID NO: 12514 - DNA, 23 bp, Artificial Sequence
  Synthetic construct
gaaaccttctctatttatctgac

SEQ ID NO: 12515 - DNA, 23 bp, Artificial Sequence
  Synthetic construct
aaaccttctctatttatctgacc

SEQ ID NO: 12516 - DNA, 23 bp, Artificial Sequence
  Synthetic construct
aaccttctctatttatctgaccg

SEQ ID NO: 12517 - DNA, 23 bp, Artificial Sequence
  Synthetic construct
accttctctatttatctgaccgc

SEQ ID NO: 12518 - DNA, 23 bp, Artificial Sequence
  Synthetic construct
ccttctctatttatctgaccgcg

SEQ ID NO: 12519 - DNA, 23 bp, Artificial Sequence
  Synthetic construct
cttctctatttatctgaccgcga

SEQ ID NO: 12520 - DNA, 23 bp, Artificial Sequence
  Synthetic construct
ttctctatttatctgaccgcgat

SEQ ID NO: 12521 - DNA, 23 bp, Artificial Sequence
  Synthetic construct
tctctatttatctgaccgcgatc

SEQ ID NO: 12522 - DNA, 23 bp, Artificial Sequence
  Synthetic construct
ctctatttatctgaccgcgatca

SEQ ID NO: 12523 - DNA, 23 bp, Artificial Sequence
  Synthetic construct
tctatttatctgaccgcgatcac

SEQ ID NO: 12524 - DNA, 23 bp, Artificial Sequence
  Synthetic construct
ctatttatctgaccgcgatcacc

SEQ ID NO: 12525 - DNA, 23 bp, Artificial Sequence
  Synthetic construct
tatttatctgaccgcgatcacca

SEQ ID NO: 12526 - DNA, 23 bp, Artificial Sequence
  Synthetic construct
atttatctgaccgcgatcaccat

SEQ ID NO: 12527 - DNA, 23 bp, Artificial Sequence
  Synthetic construct
tttatctgaccgcgatcaccatt

SEQ ID NO: 12528 - DNA, 23 bp, Artificial Sequence
  Synthetic construct
ttatctgaccgcgatcaccattc

SEQ ID NO: 12529 - DNA, 23 bp, Artificial Sequence
  Synthetic construct
tatctgaccgcgatcaccattcg

SEQ ID NO: 12530 - DNA, 23 bp, Artificial Sequence
  Synthetic construct
atctgaccgcgatcaccattcgc

SEQ ID NO: 12531 - DNA, 23 bp, Artificial Sequence
  Synthetic construct
tctgaccgcgatcaccattcgcc

SEQ ID NO: 12532 - DNA, 23 bp, Artificial Sequence
  Synthetic construct
ctgaccgcgatcaccattcgcct

SEQ ID NO: 12533 - DNA, 23 bp, Artificial Sequence
  Synthetic construct
tgaccgcgatcaccattcgcctc

SEQ ID NO: 12534 - DNA, 23 bp, Artificial Sequence
  Synthetic construct
gaccgcgatcaccattcgcctcc

SEQ ID NO: 12535 - DNA, 23 bp, Artificial Sequence
  Synthetic construct
accgcgatcaccattcgcctccc

SEQ ID NO: 12536 - DNA, 23 bp, Artificial Sequence
  Synthetic construct
ccgcgatcaccattcgcctcccg

SEQ ID NO: 12537 - DNA, 23 bp, Artificial Sequence
  Synthetic construct
cgcgatcaccattcgcctcccgt

SEQ ID NO: 12538 - DNA, 23 bp, Artificial Sequence
  Synthetic construct
gcgatcaccattcgcctcccgta

SEQ ID NO: 12539 - DNA, 23 bp, Artificial Sequence
  Synthetic construct
cgatcaccattcgcctcccgtag

SEQ ID NO: 12540 - DNA, 23 bp, Artificial Sequence
  Synthetic construct
gatcaccattcgcctcccgtagc

SEQ ID NO: 12541 - DNA, 23 bp, Artificial Sequence
  Synthetic construct
atcaccattcgcctcccgtagct

SEQ ID NO: 12542 - DNA, 23 bp, Artificial Sequence
  Synthetic construct
tcaccattcgcctcccgtagctt

SEQ ID NO: 12543 - DNA, 23 bp, Artificial Sequence
  Synthetic construct
caccattcgcctcccgtagctta

SEQ ID NO: 12544 - DNA, 23 bp, Artificial Sequence
  Synthetic construct
accattcgcctcccgtagcttag

SEQ ID NO: 12545 - DNA, 23 bp, Artificial Sequence
  Synthetic construct
ccattcgcctcccgtagcttagc

SEQ ID NO: 12546 - DNA, 23 bp, Artificial Sequence
  Synthetic construct
cattcgcctcccgtagcttagcg

SEQ ID NO: 12547 - DNA, 23 bp, Artificial Sequence
  Synthetic construct
attcgcctcccgtagcttagcga

SEQ ID NO: 12548 - DNA, 23 bp, Artificial Sequence
  Synthetic construct
ttcgcctcccgtagcttagcgat

SEQ ID NO: 12549 - DNA, 23 bp, Artificial Sequence
  Synthetic construct
tcgcctcccgtagcttagcgata

SEQ ID NO: 12550 - DNA, 23 bp, Artificial Sequence
  Synthetic construct
cgcctcccgtagcttagcgatag

SEQ ID NO: 12551 - DNA, 23 bp, Artificial Sequence
  Synthetic construct
gcctcccgtagcttagcgatagc

SEQ ID NO: 12552 - DNA, 23 bp, Artificial Sequence
  Synthetic construct
cctcccgtagcttagcgatagct

SEQ ID NO: 12553 - DNA, 23 bp, Artificial Sequence
  Synthetic construct
ctcccgtagcttagcgatagcta

SEQ ID NO: 12554 - DNA, 23 bp, Artificial Sequence
  Synthetic construct
tcccgtagcttagcgatagctaa

SEQ ID NO: 12555 - DNA, 23 bp, Artificial Sequence
  Synthetic construct
cccgtagcttagcgatagctaag

SEQ ID NO: 12556 - DNA, 23 bp, Artificial Sequence
  Synthetic construct
ccgtagcttagcgatagctaagg

SEQ ID NO: 12557 - DNA, 23 bp, Artificial Sequence
  Synthetic construct
cgtagcttagcgatagctaaggt

SEQ ID NO: 12558 - DNA, 23 bp, Artificial Sequence
  Synthetic construct
gtagcttagcgatagctaaggta

SEQ ID NO: 12559 - DNA, 23 bp, Artificial Sequence
  Synthetic construct
tagcttagcgatagctaaggtac

SEQ ID NO: 12560 - DNA, 23 bp, Artificial Sequence
  Synthetic construct
agcttagcgatagctaaggtacg

SEQ ID NO: 12561 - DNA, 23 bp, Artificial Sequence
  Synthetic construct
gcttagcgatagctaaggtacga

SEQ ID NO: 12562 - DNA, 23 bp, Artificial Sequence
  Synthetic construct
cttagcgatagctaaggtacgac

SEQ ID NO: 12563 - DNA, 23 bp, Artificial Sequence
  Synthetic construct
ttagcgatagctaaggtacgacg

SEQ ID NO: 12564 - DNA, 23 bp, Artificial Sequence
  Synthetic construct
tagcgatagctaaggtacgacgg

SEQ ID NO: 12565 - DNA, 23 bp, Artificial Sequence
  Synthetic construct
agcgatagctaaggtacgacggg

SEQ ID NO: 12566 - DNA, 23 bp, Artificial Sequence
  Synthetic construct
gcgatagctaaggtacgacgggt

SEQ ID NO: 12567 - DNA, 23 bp, Artificial Sequence
  Synthetic construct
cgatagctaaggtacgacgggtc

SEQ ID NO: 12568 - DNA, 23 bp, Artificial Sequence
  Synthetic construct
gatagctaaggtacgacgggtcg

SEQ ID NO: 12569 - DNA, 23 bp, Artificial Sequence
  Synthetic construct
atagctaaggtacgacgggtcgc

SEQ ID NO: 12570 - DNA, 23 bp, Artificial Sequence
  Synthetic construct
tagctaaggtacgacgggtcgcc

SEQ ID NO: 12571 - DNA, 23 bp, Artificial Sequence
  Synthetic construct
agctaaggtacgacgggtcgcct

SEQ ID NO: 12572 - DNA, 23 bp, Artificial Sequence
  Synthetic construct
gctaaggtacgacgggtcgcctc

SEQ ID NO: 12573 - DNA, 23 bp, Artificial Sequence
  Synthetic construct
ctaaggtacgacgggtcgcctcg

SEQ ID NO: 12574 - DNA, 23 bp, Artificial Sequence
  Synthetic construct
taaggtacgacgggtcgcctcgt

SEQ ID NO: 12575 - DNA, 23 bp, Artificial Sequence
  Synthetic construct
aaggtacgacgggtcgcctcgtc

SEQ ID NO: 12576 - DNA, 23 bp, Artificial Sequence
  Synthetic construct
aggtacgacgggtcgcctcgtca

SEQ ID NO: 12577 - DNA, 23 bp, Artificial Sequence
  Synthetic construct
ggtacgacgggtcgcctcgtcat

SEQ ID NO: 12578 - DNA, 23 bp, Artificial Sequence
  Synthetic construct
gtacgacgggtcgcctcgtcatt

SEQ ID NO: 12579 - DNA, 23 bp, Artificial Sequence
  Synthetic construct
tacgacgggtcgcctcgtcatta

SEQ ID NO: 12580 - DNA, 23 bp, Artificial Sequence
  Synthetic construct
acgacgggtcgcctcgtcattac

SEQ ID NO: 12581 - DNA, 23 bp, Artificial Sequence
  Synthetic construct
cgacgggtcgcctcgtcattacc

SEQ ID NO: 12582 - DNA, 23 bp, Artificial Sequence
  Synthetic construct
gacgggtcgcctcgtcattacca

SEQ ID NO: 12583 - DNA, 23 bp, Artificial Sequence
  Synthetic construct
acgggtcgcctcgtcattaccag

SEQ ID NO: 12584 - DNA, 23 bp, Artificial Sequence
  Synthetic construct
cgggtcgcctcgtcattaccaga

SEQ ID NO: 12585 - DNA, 23 bp, Artificial Sequence
  Synthetic construct
gggtcgcctcgtcattaccagaa

SEQ ID NO: 12586 - DNA, 23 bp, Artificial Sequence
  Synthetic construct
ggtcgcctcgtcattaccagaac

SEQ ID NO: 12587 - DNA, 23 bp, Artificial Sequence
  Synthetic construct
gtcgcctcgtcattaccagaacc

SEQ ID NO: 12588 - DNA, 23 bp, Artificial Sequence
  Synthetic construct
tcgcctcgtcattaccagaacct

SEQ ID NO: 12589 - DNA, 23 bp, Artificial Sequence
  Synthetic construct
cgcctcgtcattaccagaaccta

SEQ ID NO: 12590 - DNA, 23 bp, Artificial Sequence
  Synthetic construct
gcctcgtcattaccagaacctaa

SEQ ID NO: 12591 - DNA, 23 bp, Artificial Sequence
  Synthetic construct
cctcgtcattaccagaacctaag

SEQ ID NO: 12592 - DNA, 23 bp, Artificial Sequence
  Synthetic construct
ctcgtcattaccagaacctaagg

SEQ ID NO: 12593 - DNA, 23 bp, Artificial Sequence
  Synthetic construct
tcgtcattaccagaacctaaggt

SEQ ID NO: 12594 - DNA, 23 bp, Artificial Sequence
  Synthetic construct
cgtcattaccagaacctaaggtc

SEQ ID NO: 12595 - DNA, 23 bp, Artificial Sequence
  Synthetic construct
gtcattaccagaacctaaggtcg

SEQ ID NO: 12596 - DNA, 23 bp, Artificial Sequence
  Synthetic construct
tcattaccagaacctaaggtcgg

SEQ ID NO: 12597 - DNA, 23 bp, Artificial Sequence
  Synthetic construct
cattaccagaacctaaggtcgga

SEQ ID NO: 12598 - DNA, 23 bp, Artificial Sequence
  Synthetic construct
attaccagaacctaaggtcggat

SEQ ID NO: 12599 - DNA, 23 bp, Artificial Sequence
  Synthetic construct
ttaccagaacctaaggtcggatg

SEQ ID NO: 12600 - DNA, 23 bp, Artificial Sequence
  Synthetic construct
taccagaacctaaggtcggatgc

SEQ ID NO: 12601 - DNA, 23 bp, Artificial Sequence
  Synthetic construct
accagaacctaaggtcggatgct

SEQ ID NO: 12602 - DNA, 23 bp, Artificial Sequence
  Synthetic construct
ccagaacctaaggtcggatgctt

SEQ ID NO: 12603 - DNA, 23 bp, Artificial Sequence
  Synthetic construct
cagaacctaaggtcggatgcttt

SEQ ID NO: 12604 - DNA, 23 bp, Artificial Sequence
  Synthetic construct
agaacctaaggtcggatgctttg

SEQ ID NO: 12605 - DNA, 23 bp, Artificial Sequence
  Synthetic construct
gaacctaaggtcggatgctttgt

SEQ ID NO: 12606 - DNA, 23 bp, Artificial Sequence
  Synthetic construct
aacctaaggtcggatgctttgtg

SEQ ID NO: 12607 - DNA, 23 bp, Artificial Sequence
  Synthetic construct
acctaaggtcggatgctttgtga

SEQ ID NO: 12608 - DNA, 23 bp, Artificial Sequence
  Synthetic construct
cctaaggtcggatgctttgtgag

SEQ ID NO: 12609 - DNA, 23 bp, Artificial Sequence
  Synthetic construct
ctaaggtcggatgctttgtgagc

SEQ ID NO: 12610 - DNA, 23 bp, Artificial Sequence
  Synthetic construct
taaggtcggatgctttgtgagca

SEQ ID NO: 12611 - DNA, 23 bp, Artificial Sequence
  Synthetic construct
aaggtcggatgctttgtgagcaa

SEQ ID NO: 12612 - DNA, 23 bp, Artificial Sequence
  Synthetic construct
aggtcggatgctttgtgagcaat

SEQ ID NO: 12613 - DNA, 23 bp, Artificial Sequence
  Synthetic construct
ggtcggatgctttgtgagcaatt

SEQ ID NO: 12614 - DNA, 23 bp, Artificial Sequence
  Synthetic construct
gtcggatgctttgtgagcaattc

SEQ ID NO: 12615 - DNA, 23 bp, Artificial Sequence
  Synthetic construct
tcggatgctttgtgagcaattcg

SEQ ID NO: 12616 - DNA, 23 bp, Artificial Sequence
  Synthetic construct
cggatgctttgtgagcaattcgt

SEQ ID NO: 12617 - DNA, 23 bp, Artificial Sequence
  Synthetic construct
ggatgctttgtgagcaattcgtc

SEQ ID NO: 12618 - DNA, 23 bp, Artificial Sequence
  Synthetic construct
gatgctttgtgagcaattcgtcc

SEQ ID NO: 12619 - DNA, 23 bp, Artificial Sequence
  Synthetic construct
atgctttgtgagcaattcgtccc

SEQ ID NO: 12620 - DNA, 23 bp, Artificial Sequence
  Synthetic construct
tgctttgtgagcaattcgtccct

SEQ ID NO: 12621 - DNA, 23 bp, Artificial Sequence
  Synthetic construct
gctttgtgagcaattcgtccctt

SEQ ID NO: 12622 - DNA, 23 bp, Artificial Sequence
  Synthetic construct
ctttgtgagcaattcgtccctta

SEQ ID NO: 12623 - DNA, 23 bp, Artificial Sequence
  Synthetic construct
tttgtgagcaattcgtcccttaa

SEQ ID NO: 12624 - DNA, 23 bp, Artificial Sequence
  Synthetic construct
ttgtgagcaattcgtcccttaag

SEQ ID NO: 12625 - DNA, 23 bp, Artificial Sequence
  Synthetic construct
tgtgagcaattcgtcccttaagt

SEQ ID NO: 12626 - DNA, 23 bp, Artificial Sequence
  Synthetic construct
gtgagcaattcgtcccttaagta

SEQ ID NO: 12627 - DNA, 23 bp, Artificial Sequence
  Synthetic construct
tgagcaattcgtcccttaagtaa

SEQ ID NO: 12628 - DNA, 23 bp, Artificial Sequence
  Synthetic construct
gagcaattcgtcccttaagtaag

SEQ ID NO: 12629 - DNA, 23 bp, Artificial Sequence
  Synthetic construct
agcaattcgtcccttaagtaagc

SEQ ID NO: 12630 - DNA, 23 bp, Artificial Sequence
  Synthetic construct
gcaattcgtcccttaagtaagca

SEQ ID NO: 12631 - DNA, 23 bp, Artificial Sequence
  Synthetic construct
caattcgtcccttaagtaagcaa

SEQ ID NO: 12632 - DNA, 23 bp, Artificial Sequence
  Synthetic construct
aattcgtcccttaagtaagcaat

SEQ ID NO: 12633 - DNA, 23 bp, Artificial Sequence
  Synthetic construct
attcgtcccttaagtaagcaatt

SEQ ID NO: 12634 - DNA, 23 bp, Artificial Sequence
  Synthetic construct
ttcgtcccttaagtaagcaattg

SEQ ID NO: 12635 - DNA, 23 bp, Artificial Sequence
  Synthetic construct
tcgtcccttaagtaagcaattgc

SEQ ID NO: 12636 - DNA, 23 bp, Artificial Sequence
  Synthetic construct
cgtcccttaagtaagcaattgct

SEQ ID NO: 12637 - DNA, 23 bp, Artificial Sequence
  Synthetic construct
gtcccttaagtaagcaattgctg

SEQ ID NO: 12638 - DNA, 23 bp, Artificial Sequence
  Synthetic construct
tcccttaagtaagcaattgctgt

SEQ ID NO: 12639 - DNA, 23 bp, Artificial Sequence
  Synthetic construct
cccttaagtaagcaattgctgta

SEQ ID NO: 12640 - DNA, 23 bp, Artificial Sequence
  Synthetic construct
ccttaagtaagcaattgctgtaa

SEQ ID NO: 12641 - DNA, 23 bp, Artificial Sequence
  Synthetic construct
cttaagtaagcaattgctgtaaa

SEQ ID NO: 12642 - DNA, 23 bp, Artificial Sequence
  Synthetic construct
ttaagtaagcaattgctgtaaag

SEQ ID NO: 12643 - DNA, 23 bp, Artificial Sequence
  Synthetic construct
taagtaagcaattgctgtaaagt

SEQ ID NO: 12644 - DNA, 23 bp, Artificial Sequence
  Synthetic construct
aagtaagcaattgctgtaaagtc

SEQ ID NO: 12645 - DNA, 23 bp, Artificial Sequence
  Synthetic construct
agtaagcaattgctgtaaagtcg

SEQ ID NO: 12646 - DNA, 23 bp, Artificial Sequence
  Synthetic construct
gtaagcaattgctgtaaagtcgt

SEQ ID NO: 12647 - DNA, 23 bp, Artificial Sequence
  Synthetic construct
taagcaattgctgtaaagtcgtc

SEQ ID NO: 12648 - DNA, 23 bp, Artificial Sequence
  Synthetic construct
aagcaattgctgtaaagtcgtca

SEQ ID NO: 12649 - DNA, 23 bp, Artificial Sequence
  Synthetic construct
agcaattgctgtaaagtcgtcac

SEQ ID NO: 12650 - DNA, 23 bp, Artificial Sequence
  Synthetic construct
gcaattgctgtaaagtcgtcact

SEQ ID NO: 12651 - DNA, 23 bp, Artificial Sequence
  Synthetic construct
caattgctgtaaagtcgtcactg

SEQ ID NO: 12652 - DNA, 23 bp, Artificial Sequence
  Synthetic construct
aattgctgtaaagtcgtcactgt

SEQ ID NO: 12653 - DNA, 23 bp, Artificial Sequence
  Synthetic construct
attgctgtaaagtcgtcactgtg

SEQ ID NO: 12654 - DNA, 23 bp, Artificial Sequence
  Synthetic construct
ttgctgtaaagtcgtcactgtgc

SEQ ID NO: 12655 - DNA, 23 bp, Artificial Sequence
  Synthetic construct
tgctgtaaagtcgtcactgtgcg

SEQ ID NO: 12656 - DNA, 23 bp, Artificial Sequence
  Synthetic construct
gctgtaaagtcgtcactgtgcgg

SEQ ID NO: 12657 - DNA, 23 bp, Artificial Sequence
  Synthetic construct
ctgtaaagtcgtcactgtgcgga

SEQ ID NO: 12658 - DNA, 23 bp, Artificial Sequence
  Synthetic construct
tgtaaagtcgtcactgtgcggat

SEQ ID NO: 12659 - DNA, 23 bp, Artificial Sequence
  Synthetic construct
gtaaagtcgtcactgtgcggatc

SEQ ID NO: 12660 - DNA, 23 bp, Artificial Sequence
  Synthetic construct
taaagtcgtcactgtgcggatca

SEQ ID NO: 12661 - DNA, 23 bp, Artificial Sequence
  Synthetic construct
aaagtcgtcactgtgcggatcac

SEQ ID NO: 12662 - DNA, 23 bp, Artificial Sequence
  Synthetic construct
aagtcgtcactgtgcggatcacc

SEQ ID NO: 12663 - DNA, 23 bp, Artificial Sequence
  Synthetic construct
agtcgtcactgtgcggatcaccg

SEQ ID NO: 12664 - DNA, 23 bp, Artificial Sequence
  Synthetic construct
gtcgtcactgtgcggatcaccgc

SEQ ID NO: 12665 - DNA, 23 bp, Artificial Sequence
  Synthetic construct
tcgtcactgtgcggatcaccgct

SEQ ID NO: 12666 - DNA, 23 bp, Artificial Sequence
  Synthetic construct
cgtcactgtgcggatcaccgctt

SEQ ID NO: 12667 - DNA, 23 bp, Artificial Sequence
  Synthetic construct
gtcactgtgcggatcaccgcttc

SEQ ID NO: 12668 - DNA, 23 bp, Artificial Sequence
  Synthetic construct
tcactgtgcggatcaccgcttcc

SEQ ID NO: 12669 - DNA, 23 bp, Artificial Sequence
  Synthetic construct
cactgtgcggatcaccgcttcca

SEQ ID NO: 12670 - DNA, 23 bp, Artificial Sequence
  Synthetic construct
actgtgcggatcaccgcttccag

SEQ ID NO: 12671 - DNA, 23 bp, Artificial Sequence
  Synthetic construct
ctgtgcggatcaccgcttccagt

SEQ ID NO: 12672 - DNA, 23 bp, Artificial Sequence
  Synthetic construct
tgtgcggatcaccgcttccagta

SEQ ID NO: 12673 - DNA, 23 bp, Artificial Sequence
  Synthetic construct
gtgcggatcaccgcttccagtag

SEQ ID NO: 12674 - DNA, 23 bp, Artificial Sequence
  Synthetic construct
tgcggatcaccgcttccagtagc

SEQ ID NO: 12675 - DNA, 23 bp, Artificial Sequence
  Synthetic construct
gcggatcaccgcttccagtagcg

SEQ ID NO: 12676 - DNA, 23 bp, Artificial Sequence
  Synthetic construct
cggatcaccgcttccagtagcga

SEQ ID NO: 12677 - DNA, 23 bp, Artificial Sequence
  Synthetic construct
ggatcaccgcttccagtagcgac

SEQ ID NO: 12678 - DNA, 23 bp, Artificial Sequence
  Synthetic construct
gatcaccgcttccagtagcgaca

SEQ ID NO: 12679 - DNA, 23 bp, Artificial Sequence
  Synthetic construct
atcaccgcttccagtagcgacag

SEQ ID NO: 12680 - DNA, 23 bp, Artificial Sequence
  Synthetic construct
tcaccgcttccagtagcgacaga

SEQ ID NO: 12681 - DNA, 23 bp, Artificial Sequence
  Synthetic construct
caccgcttccagtagcgacagaa

SEQ ID NO: 12682 - DNA, 23 bp, Artificial Sequence
  Synthetic construct
accgcttccagtagcgacagaag

SEQ ID NO: 12683 - DNA, 23 bp, Artificial Sequence
  Synthetic construct
ccgcttccagtagcgacagaagc

SEQ ID NO: 12684 - DNA, 23 bp, Artificial Sequence
  Synthetic construct
cgcttccagtagcgacagaagca

SEQ ID NO: 12685 - DNA, 23 bp, Artificial Sequence
  Synthetic construct
gcttccagtagcgacagaagcaa

SEQ ID NO: 12686 - DNA, 23 bp, Artificial Sequence
  Synthetic construct
cttccagtagcgacagaagcaat

SEQ ID NO: 12687 - DNA, 23 bp, Artificial Sequence
  Synthetic construct
ttccagtagcgacagaagcaatt

SEQ ID NO: 12688 - DNA, 23 bp, Artificial Sequence
  Synthetic construct
tccagtagcgacagaagcaattg

SEQ ID NO: 12689 - DNA, 23 bp, Artificial Sequence
  Synthetic construct
ccagtagcgacagaagcaattga

SEQ ID NO: 12690 - DNA, 23 bp, Artificial Sequence
  Synthetic construct
cagtagcgacagaagcaattgat

SEQ ID NO: 12691 - DNA, 23 bp, Artificial Sequence
  Synthetic construct
agtagcgacagaagcaattgatt

SEQ ID NO: 12692 - DNA, 23 bp, Artificial Sequence
  Synthetic construct
gtagcgacagaagcaattgattg

SEQ ID NO: 12693 - DNA, 23 bp, Artificial Sequence
  Synthetic construct
tagcgacagaagcaattgattgg

SEQ ID NO: 12694 - DNA, 23 bp, Artificial Sequence
  Synthetic construct
agcgacagaagcaattgattggt

SEQ ID NO: 12695 - DNA, 23 bp, Artificial Sequence
  Synthetic construct
gcgacagaagcaattgattggta

SEQ ID NO: 12696 - DNA, 23 bp, Artificial Sequence
  Synthetic construct
cgacagaagcaattgattggtaa

SEQ ID NO: 12697 - DNA, 23 bp, Artificial Sequence
  Synthetic construct
gacagaagcaattgattggtaaa

SEQ ID NO: 12698 - DNA, 23 bp, Artificial Sequence
  Synthetic construct
acagaagcaattgattggtaaat

SEQ ID NO: 12699 - DNA, 23 bp, Artificial Sequence
  Synthetic construct
cagaagcaattgattggtaaatt

SEQ ID NO: 12700 - DNA, 23 bp, Artificial Sequence
  Synthetic construct
agaagcaattgattggtaaattt

SEQ ID NO: 12701 - DNA, 23 bp, Artificial Sequence
  Synthetic construct
gaagcaattgattggtaaatttc

SEQ ID NO: 12702 - DNA, 23 bp, Artificial Sequence
  Synthetic construct
aagcaattgattggtaaatttcg

SEQ ID NO: 12703 - DNA, 23 bp, Artificial Sequence
  Synthetic construct
agcaattgattggtaaatttcga

SEQ ID NO: 12704 - DNA, 23 bp, Artificial Sequence
  Synthetic construct
gcaattgattggtaaatttcgag

SEQ ID NO: 12705 - DNA, 23 bp, Artificial Sequence
  Synthetic construct
caattgattggtaaatttcgaga

SEQ ID NO: 12706 - DNA, 23 bp, Artificial Sequence
  Synthetic construct
aattgattggtaaatttcgagag

SEQ ID NO: 12707 - DNA, 23 bp, Artificial Sequence
  Synthetic construct
attgattggtaaatttcgagaga

SEQ ID NO: 12708 - DNA, 23 bp, Artificial Sequence
  Synthetic construct
ttgattggtaaatttcgagagaa

SEQ ID NO: 12709 - DNA, 23 bp, Artificial Sequence
  Synthetic construct
tgattggtaaatttcgagagaaa

SEQ ID NO: 12710 - DNA, 23 bp, Artificial Sequence
  Synthetic construct
gattggtaaatttcgagagaaag

SEQ ID NO: 12711 - DNA, 23 bp, Artificial Sequence
  Synthetic construct
attggtaaatttcgagagaaaga

SEQ ID NO: 12712 - DNA, 23 bp, Artificial Sequence
  Synthetic construct
ttggtaaatttcgagagaaagat

SEQ ID NO: 12713 - DNA, 23 bp, Artificial Sequence
  Synthetic construct
tggtaaatttcgagagaaagatc

SEQ ID NO: 12714 - DNA, 23 bp, Artificial Sequence
  Synthetic construct
ggtaaatttcgagagaaagatcg

SEQ ID NO: 12715 - DNA, 23 bp, Artificial Sequence
  Synthetic construct
gtaaatttcgagagaaagatcgc

SEQ ID NO: 12716 - DNA, 23 bp, Artificial Sequence
  Synthetic construct
taaatttcgagagaaagatcgcg

SEQ ID NO: 12717 - DNA, 23 bp, Artificial Sequence
  Synthetic construct
aaatttcgagagaaagatcgcga

SEQ ID NO: 12718 - DNA, 23 bp, Artificial Sequence
  Synthetic construct
aatttcgagagaaagatcgcgag

SEQ ID NO: 12719 - DNA, 23 bp, Artificial Sequence
  Synthetic construct
atttcgagagaaagatcgcgagg

SEQ ID NO: 12720 - DNA, 23 bp, Artificial Sequence
  Synthetic construct
tttcgagagaaagatcgcgagga

SEQ ID NO: 12721 - DNA, 23 bp, Artificial Sequence
  Synthetic construct
ttcgagagaaagatcgcgaggaa

SEQ ID NO: 12722 - DNA, 23 bp, Artificial Sequence
  Synthetic construct
tcgagagaaagatcgcgaggaag

SEQ ID NO: 12723 - DNA, 23 bp, Artificial Sequence
  Synthetic construct
cgagagaaagatcgcgaggaaga

SEQ ID NO: 12724 - DNA, 23 bp, Artificial Sequence
  Synthetic construct
gagagaaagatcgcgaggaagat

SEQ ID NO: 12725 - DNA, 23 bp, Artificial Sequence
  Synthetic construct
agagaaagatcgcgaggaagatc

SEQ ID NO: 12726 - DNA, 23 bp, Artificial Sequence
  Synthetic construct
gagaaagatcgcgaggaagatca

SEQ ID NO: 12727 - DNA, 23 bp, Artificial Sequence
  Synthetic construct
agaaagatcgcgaggaagatcaa

SEQ ID NO: 12728 - DNA, 23 bp, Artificial Sequence
  Synthetic construct
gaaagatcgcgaggaagatcaat

SEQ ID NO: 12729 - DNA, 23 bp, Artificial Sequence
  Synthetic construct
aaagatcgcgaggaagatcaata

SEQ ID NO: 12730 - DNA, 23 bp, Artificial Sequence
  Synthetic construct
aagatcgcgaggaagatcaatac

SEQ ID NO: 12731 - DNA, 23 bp, Artificial Sequence
  Synthetic construct
agatcgcgaggaagatcaataca

SEQ ID NO: 12732 - DNA, 23 bp, Artificial Sequence
  Synthetic construct
gatcgcgaggaagatcaatacat

SEQ ID NO: 12733 - DNA, 23 bp, Artificial Sequence
  Synthetic construct
atcgcgaggaagatcaatacata

SEQ ID NO: 12734 - DNA, 23 bp, Artificial Sequence
  Synthetic construct
tcgcgaggaagatcaatacataa

SEQ ID NO: 12735 - DNA, 23 bp, Artificial Sequence
  Synthetic construct
cgcgaggaagatcaatacataaa

SEQ ID NO: 12736 - DNA, 23 bp, Artificial Sequence
  Synthetic construct
gcgaggaagatcaatacataaag

SEQ ID NO: 12737 - DNA, 23 bp, Artificial Sequence
  Synthetic construct
cgaggaagatcaatacataaaga

SEQ ID NO: 12738 - DNA, 23 bp, Artificial Sequence
  Synthetic construct
gaggaagatcaatacataaagag

SEQ ID NO: 12739 - DNA, 23 bp, Artificial Sequence
  Synthetic construct
aggaagatcaatacataaagagt

SEQ ID NO: 12740 - DNA, 23 bp, Artificial Sequence
  Synthetic construct
ggaagatcaatacataaagagtt

SEQ ID NO: 12741 - DNA, 23 bp, Artificial Sequence
  Synthetic construct
gaagatcaatacataaagagttg

SEQ ID NO: 12742 - DNA, 23 bp, Artificial Sequence
  Synthetic construct
aagatcaatacataaagagttga

SEQ ID NO: 12743 - DNA, 23 bp, Artificial Sequence
  Synthetic construct
agatcaatacataaagagttgaa

SEQ ID NO: 12744 - DNA, 23 bp, Artificial Sequence
  Synthetic construct
gatcaatacataaagagttgaac

SEQ ID NO: 12745 - DNA, 23 bp, Artificial Sequence
  Synthetic construct
atcaatacataaagagttgaact

SEQ ID NO: 12746 - DNA, 23 bp, Artificial Sequence
  Synthetic construct
tcaatacataaagagttgaactt

SEQ ID NO: 12747 - DNA, 23 bp, Artificial Sequence
  Synthetic construct
caatacataaagagttgaacttc

SEQ ID NO: 12748 - DNA, 23 bp, Artificial Sequence
  Synthetic construct
aatacataaagagttgaacttct

SEQ ID NO: 12749 - DNA, 23 bp, Artificial Sequence
  Synthetic construct
atacataaagagttgaacttctt

SEQ ID NO: 12750 - DNA, 23 bp, Artificial Sequence
  Synthetic construct
tacataaagagttgaacttcttt

SEQ ID NO: 12751 - DNA, 23 bp, Artificial Sequence
  Synthetic construct
acataaagagttgaacttctttg

SEQ ID NO: 12752 - DNA, 23 bp, Artificial Sequence
  Synthetic construct
cataaagagttgaacttctttgt

SEQ ID NO: 12753 - DNA, 23 bp, Artificial Sequence
  Synthetic construct
ataaagagttgaacttctttgtt

SEQ ID NO: 12754 - DNA, 23 bp, Artificial Sequence
  Synthetic construct
taaagagttgaacttctttgttg

SEQ ID NO: 12755 - DNA, 23 bp, Artificial Sequence
  Synthetic construct
aaagagttgaacttctttgttgt

SEQ ID NO: 12756 - DNA, 23 bp, Artificial Sequence
  Synthetic construct
aagagttgaacttctttgttgtc

SEQ ID NO: 12757 - DNA, 23 bp, Artificial Sequence
  Synthetic construct
agagttgaacttctttgttgtct

SEQ ID NO: 12758 - DNA, 23 bp, Artificial Sequence
  Synthetic construct
gagttgaacttctttgttgtctt

SEQ ID NO: 12759 - DNA, 23 bp, Artificial Sequence
  Synthetic construct
agttgaacttctttgttgtcttc

SEQ ID NO: 12760 - DNA, 23 bp, Artificial Sequence
  Synthetic construct
gttgaacttctttgttgtcttcg

SEQ ID NO: 12761 - DNA, 23 bp, Artificial Sequence
  Synthetic construct
ttgaacttctttgttgtcttcga

SEQ ID NO: 12762 - DNA, 23 bp, Artificial Sequence
  Synthetic construct
tgaacttctttgttgtcttcgac

SEQ ID NO: 12763 - DNA, 23 bp, Artificial Sequence
  Synthetic construct
gaacttctttgttgtcttcgaca

SEQ ID NO: 12764 - DNA, 23 bp, Artificial Sequence
  Synthetic construct
aacttctttgttgtcttcgacat

SEQ ID NO: 12765 - DNA, 23 bp, Artificial Sequence
  Synthetic construct
acttctttgttgtcttcgacatg

SEQ ID NO: 12766 - DNA, 23 bp, Artificial Sequence
  Synthetic construct
cttctttgttgtcttcgacatgg

SEQ ID NO: 12767 - DNA, 23 bp, Artificial Sequence
  Synthetic construct
ttctttgttgtcttcgacatggg

SEQ ID NO: 12768 - DNA, 23 bp, Artificial Sequence
  Synthetic construct
tctttgttgtcttcgacatgggt

SEQ ID NO: 12769 - DNA, 23 bp, Artificial Sequence
  Synthetic construct
ctttgttgtcttcgacatgggta

SEQ ID NO: 12770 - DNA, 23 bp, Artificial Sequence
  Synthetic construct
tttgttgtcttcgacatgggtaa

SEQ ID NO: 12771 - DNA, 23 bp, Artificial Sequence
  Synthetic construct
ttgttgtcttcgacatgggtaat

SEQ ID NO: 12772 - DNA, 23 bp, Artificial Sequence
  Synthetic construct
tgttgtcttcgacatgggtaatc

SEQ ID NO: 12773 - DNA, 23 bp, Artificial Sequence
  Synthetic construct
gttgtcttcgacatgggtaatcc

SEQ ID NO: 12774 - DNA, 23 bp, Artificial Sequence
  Synthetic construct
ttgtcttcgacatgggtaatcct

SEQ ID NO: 12775 - DNA, 23 bp, Artificial Sequence
  Synthetic construct
tgtcttcgacatgggtaatcctc

SEQ ID NO: 12776 - DNA, 23 bp, Artificial Sequence
  Synthetic construct
gtcttcgacatgggtaatcctca

SEQ ID NO: 12777 - DNA, 23 bp, Artificial Sequence
  Synthetic construct
tcttcgacatgggtaatcctcat

SEQ ID NO: 12778 - DNA, 23 bp, Artificial Sequence
  Synthetic construct
cttcgacatgggtaatcctcatg

SEQ ID NO: 12779 - DNA, 23 bp, Artificial Sequence
  Synthetic construct
ttcgacatgggtaatcctcatgt

SEQ ID NO: 12780 - DNA, 23 bp, Artificial Sequence
  Synthetic construct
tcgacatgggtaatcctcatgtt

SEQ ID NO: 12781 - DNA, 23 bp, Artificial Sequence
  Synthetic construct
cgacatgggtaatcctcatgttt

SEQ ID NO: 12782 - DNA, 23 bp, Artificial Sequence
  Synthetic construct
gacatgggtaatcctcatgtttg

SEQ ID NO: 12783 - DNA, 23 bp, Artificial Sequence
  Synthetic construct
acatgggtaatcctcatgtttga

SEQ ID NO: 12784 - DNA, 23 bp, Artificial Sequence
  Synthetic construct
catgggtaatcctcatgtttgaa

SEQ ID NO: 12785 - DNA, 23 bp, Artificial Sequence
  Synthetic construct
atgggtaatcctcatgtttgaat

SEQ ID NO: 12786 - DNA, 23 bp, Artificial Sequence
  Synthetic construct
tgggtaatcctcatgtttgaatg

SEQ ID NO: 12787 - DNA, 23 bp, Artificial Sequence
  Synthetic construct
gggtaatcctcatgtttgaatgg

SEQ ID NO: 12788 - DNA, 23 bp, Artificial Sequence
  Synthetic construct
ggtaatcctcatgtttgaatggc

SEQ ID NO: 12789 - DNA, 23 bp, Artificial Sequence
  Synthetic construct
gtaatcctcatgtttgaatggcc

SEQ ID NO: 12790 - DNA, 23 bp, Artificial Sequence
  Synthetic construct
taatcctcatgtttgaatggccg

SEQ ID NO: 12791 - DNA, 23 bp, Artificial Sequence
  Synthetic construct
aatcctcatgtttgaatggccgg

SEQ ID NO: 12792 - DNA, 23 bp, Artificial Sequence
  Synthetic construct
atcctcatgtttgaatggccggc

SEQ ID NO: 12793 - DNA, 23 bp, Artificial Sequence
  Synthetic construct
tcctcatgtttgaatggccggcg

SEQ ID NO: 12794 - DNA, 23 bp, Artificial Sequence
  Synthetic construct
cctcatgtttgaatggccggcgt

SEQ ID NO: 12795 - DNA, 23 bp, Artificial Sequence
  Synthetic construct
ctcatgtttgaatggccggcgtc

SEQ ID NO: 12796 - DNA, 23 bp, Artificial Sequence
  Synthetic construct
tcatgtttgaatggccggcgtct

SEQ ID NO: 12797 - DNA, 23 bp, Artificial Sequence
  Synthetic construct
catgtttgaatggccggcgtcta

SEQ ID NO: 12798 - DNA, 23 bp, Artificial Sequence
  Synthetic construct
atgtttgaatggccggcgtctat

SEQ ID NO: 12799 - DNA, 23 bp, Artificial Sequence
  Synthetic construct
tgtttgaatggccggcgtctatt

SEQ ID NO: 12800 - DNA, 23 bp, Artificial Sequence
  Synthetic construct
gtttgaatggccggcgtctatta

SEQ ID NO: 12801 - DNA, 23 bp, Artificial Sequence
  Synthetic construct
tttgaatggccggcgtctattag

SEQ ID NO: 12802 - DNA, 23 bp, Artificial Sequence
  Synthetic construct
ttgaatggccggcgtctattagt

SEQ ID NO: 12803 - DNA, 23 bp, Artificial Sequence
  Synthetic construct
tgaatggccggcgtctattagta

SEQ ID NO: 12804 - DNA, 23 bp, Artificial Sequence
  Synthetic construct
gaatggccggcgtctattagtag

SEQ ID NO: 12805 - DNA, 23 bp, Artificial Sequence
  Synthetic construct
aatggccggcgtctattagtaga

SEQ ID NO: 12806 - DNA, 23 bp, Artificial Sequence
  Synthetic construct
atggccggcgtctattagtagat

SEQ ID NO: 12807 - DNA, 23 bp, Artificial Sequence
  Synthetic construct
tggccggcgtctattagtagatg

SEQ ID NO: 12808 - DNA, 23 bp, Artificial Sequence
  Synthetic construct
ggccggcgtctattagtagatgc

SEQ ID NO: 12809 - DNA, 23 bp, Artificial Sequence
  Synthetic construct
gccggcgtctattagtagatgcc

SEQ ID NO: 12810 - DNA, 23 bp, Artificial Sequence
  Synthetic construct
ccggcgtctattagtagatgccg

SEQ ID NO: 12811 - DNA, 23 bp, Artificial Sequence
  Synthetic construct
cggcgtctattagtagatgccgg

SEQ ID NO: 12812 - DNA, 23 bp, Artificial Sequence
  Synthetic construct
ggcgtctattagtagatgccgga

SEQ ID NO: 12813 - DNA, 23 bp, Artificial Sequence
  Synthetic construct
gcgtctattagtagatgccggag

SEQ ID NO: 12814 - DNA, 23 bp, Artificial Sequence
  Synthetic construct
cgtctattagtagatgccggagt

SEQ ID NO: 12815 - DNA, 23 bp, Artificial Sequence
  Synthetic construct
gtctattagtagatgccggagtt

SEQ ID NO: 12816 - DNA, 23 bp, Artificial Sequence
  Synthetic construct
tctattagtagatgccggagttt

SEQ ID NO: 12817 - DNA, 23 bp, Artificial Sequence
  Synthetic construct
ctattagtagatgccggagtttg

SEQ ID NO: 12818 - DNA, 23 bp, Artificial Sequence
  Synthetic construct
tattagtagatgccggagtttgc

SEQ ID NO: 12819 - DNA, 23 bp, Artificial Sequence
  Synthetic construct
attagtagatgccggagtttgct

SEQ ID NO: 12820 - DNA, 23 bp, Artificial Sequence
  Synthetic construct
ttagtagatgccggagtttgctg

SEQ ID NO: 12821 - DNA, 23 bp, Artificial Sequence
  Synthetic construct
tagtagatgccggagtttgctgc

SEQ ID NO: 12822 - DNA, 23 bp, Artificial Sequence
  Synthetic construct
agtagatgccggagtttgctgcg

SEQ ID NO: 12823 - DNA, 23 bp, Artificial Sequence
  Synthetic construct
gtagatgccggagtttgctgcga

SEQ ID NO: 12824 - DNA, 23 bp, Artificial Sequence
  Synthetic construct
tagatgccggagtttgctgcgat

SEQ ID NO: 12825 - DNA, 23 bp, Artificial Sequence
  Synthetic construct
agatgccggagtttgctgcgatt

SEQ ID NO: 12826 - DNA, 23 bp, Artificial Sequence
  Synthetic construct
gatgccggagtttgctgcgattg

SEQ ID NO: 12827 - DNA, 23 bp, Artificial Sequence
  Synthetic construct
atgccggagtttgctgcgattgc

SEQ ID NO: 12828 - DNA, 23 bp, Artificial Sequence
  Synthetic construct
tgccggagtttgctgcgattgct

SEQ ID NO: 12829 - DNA, 23 bp, Artificial Sequence
  Synthetic construct
gccggagtttgctgcgattgctg

SEQ ID NO: 12830 - DNA, 23 bp, Artificial Sequence
  Synthetic construct
ccggagtttgctgcgattgctga

SEQ ID NO: 12831 - DNA, 23 bp, Artificial Sequence
  Synthetic construct
cggagtttgctgcgattgctgag

SEQ ID NO: 12832 - DNA, 23 bp, Artificial Sequence
  Synthetic construct
ggagtttgctgcgattgctgagg

SEQ ID NO: 12833 - DNA, 23 bp, Artificial Sequence
  Synthetic construct
gagtttgctgcgattgctgaggg

SEQ ID NO: 12834 - DNA, 23 bp, Artificial Sequence
  Synthetic construct
agtttgctgcgattgctgaggga

SEQ ID NO: 12835 - DNA, 23 bp, Artificial Sequence
  Synthetic construct
gtttgctgcgattgctgagggaa

SEQ ID NO: 12836 - DNA, 23 bp, Artificial Sequence
  Synthetic construct
tttgctgcgattgctgagggaat

SEQ ID NO: 12837 - DNA, 23 bp, Artificial Sequence
  Synthetic construct
ttgctgcgattgctgagggaatc

SEQ ID NO: 12838 - DNA, 23 bp, Artificial Sequence
  Synthetic construct
tgctgcgattgctgagggaatcg

SEQ ID NO: 12839 - DNA, 23 bp, Artificial Sequence
  Synthetic construct
gctgcgattgctgagggaatcgg

SEQ ID NO: 12840 - DNA, 23 bp, Artificial Sequence
  Synthetic construct
ctgcgattgctgagggaatcggg

SEQ ID NO: 12841 - DNA, 23 bp, Artificial Sequence
  Synthetic construct
tgcgattgctgagggaatcgggt

SEQ ID NO: 12842 - DNA, 23 bp, Artificial Sequence
  Synthetic construct
gcgattgctgagggaatcgggtt

SEQ ID NO: 12843 - DNA, 23 bp, Artificial Sequence
  Synthetic construct
cgattgctgagggaatcgggttt

SEQ ID NO: 12844 - DNA, 23 bp, Artificial Sequence
  Synthetic construct
gattgctgagggaatcgggtttc

SEQ ID NO: 12845 - DNA, 23 bp, Artificial Sequence
  Synthetic construct
attgctgagggaatcgggtttcc

SEQ ID NO: 12846 - DNA, 23 bp, Artificial Sequence
  Synthetic construct
ttgctgagggaatcgggtttcca

SEQ ID NO: 12847 - DNA, 23 bp, Artificial Sequence
  Synthetic construct
tgctgagggaatcgggtttccat

SEQ ID NO: 12848 - DNA, 23 bp, Artificial Sequence
  Synthetic construct
gctgagggaatcgggtttccatc

SEQ ID NO: 12849 - DNA, 23 bp, Artificial Sequence
  Synthetic construct
ctgagggaatcgggtttccatct

SEQ ID NO: 12850 - DNA, 23 bp, Artificial Sequence
  Synthetic construct
tgagggaatcgggtttccatctt

SEQ ID NO: 12851 - DNA, 23 bp, Artificial Sequence
  Synthetic construct
gagggaatcgggtttccatcttt

SEQ ID NO: 12852 - DNA, 23 bp, Artificial Sequence
  Synthetic construct
agggaatcgggtttccatctttt

SEQ ID NO: 12853 - DNA, 23 bp, Artificial Sequence
  Synthetic construct
gggaatcgggtttccatctttta

SEQ ID NO: 12854 - DNA, 23 bp, Artificial Sequence
  Synthetic construct
ggaatcgggtttccatcttttag

SEQ ID NO: 12855 - DNA, 23 bp, Artificial Sequence
  Synthetic construct
gaatcgggtttccatcttttagg

SEQ ID NO: 12856 - DNA, 23 bp, Artificial Sequence
  Synthetic construct
aatcgggtttccatcttttagga

SEQ ID NO: 12857 - DNA, 23 bp, Artificial Sequence
  Synthetic construct
atcgggtttccatcttttaggag

SEQ ID NO: 12858 - DNA, 23 bp, Artificial Sequence
  Synthetic construct
tcgggtttccatcttttaggaga

SEQ ID NO: 12859 - DNA, 23 bp, Artificial Sequence
  Synthetic construct
cgggtttccatcttttaggagac

SEQ ID NO: 12860 - DNA, 23 bp, Artificial Sequence
  Synthetic construct
gggtttccatcttttaggagacc

SEQ ID NO: 12861 - DNA, 23 bp, Artificial Sequence
  Synthetic construct
ggtttccatcttttaggagacct

SEQ ID NO: 12862 - DNA, 23 bp, Artificial Sequence
  Synthetic construct
gtttccatcttttaggagacctt

SEQ ID NO: 12863 - DNA, 23 bp, Artificial Sequence
  Synthetic construct
tttccatcttttaggagaccttg

SEQ ID NO: 12864 - DNA, 23 bp, Artificial Sequence
  Synthetic construct
ttccatcttttaggagaccttgc

SEQ ID NO: 12865 - DNA, 23 bp, Artificial Sequence
  Synthetic construct
tccatcttttaggagaccttgca

SEQ ID NO: 12866 - DNA, 23 bp, Artificial Sequence
  Synthetic construct
ccatcttttaggagaccttgcat

SEQ ID NO: 12867 - DNA, 23 bp, Artificial Sequence
  Synthetic construct
catcttttaggagaccttgcatt

SEQ ID NO: 12868 - DNA, 23 bp, Artificial Sequence
  Synthetic construct
atcttttaggagaccttgcattg

SEQ ID NO: 12869 - DNA, 23 bp, Artificial Sequence
  Synthetic construct
tcttttaggagaccttgcattgc

SEQ ID NO: 12870 - DNA, 23 bp, Artificial Sequence
  Synthetic construct
cttttaggagaccttgcattgcc

SEQ ID NO: 12871 - DNA, 23 bp, Artificial Sequence
  Synthetic construct
ttttaggagaccttgcattgcct

SEQ ID NO: 12872 - DNA, 23 bp, Artificial Sequence
  Synthetic construct
tttaggagaccttgcattgcctt

SEQ ID NO: 12873 - DNA, 23 bp, Artificial Sequence
  Synthetic construct
ttaggagaccttgcattgcctta

SEQ ID NO: 12874 - DNA, 23 bp, Artificial Sequence
  Synthetic construct
taggagaccttgcattgccttaa

SEQ ID NO: 12875 - DNA, 23 bp, Artificial Sequence
  Synthetic construct
aggagaccttgcattgccttaac

SEQ ID NO: 12876 - DNA, 23 bp, Artificial Sequence
  Synthetic construct
ggagaccttgcattgccttaaca

SEQ ID NO: 12877 - DNA, 23 bp, Artificial Sequence
  Synthetic construct
gagaccttgcattgccttaacaa

SEQ ID NO: 12878 - DNA, 23 bp, Artificial Sequence
  Synthetic construct
agaccttgcattgccttaacaat

SEQ ID NO: 12879 - DNA, 23 bp, Artificial Sequence
  Synthetic construct
gaccttgcattgccttaacaata

SEQ ID NO: 12880 - DNA, 23 bp, Artificial Sequence
  Synthetic construct
accttgcattgccttaacaataa

SEQ ID NO: 12881 - DNA, 23 bp, Artificial Sequence
  Synthetic construct
ccttgcattgccttaacaataag

SEQ ID NO: 12882 - DNA, 23 bp, Artificial Sequence
  Synthetic construct
cttgcattgccttaacaataagc

SEQ ID NO: 12883 - DNA, 23 bp, Artificial Sequence
  Synthetic construct
ttgcattgccttaacaataagct

SEQ ID NO: 12884 - DNA, 23 bp, Artificial Sequence
  Synthetic construct
tgcattgccttaacaataagctc

SEQ ID NO: 12885 - DNA, 23 bp, Artificial Sequence
  Synthetic construct
gcattgccttaacaataagctcg

SEQ ID NO: 12886 - DNA, 23 bp, Artificial Sequence
  Synthetic construct
cattgccttaacaataagctcgc

SEQ ID NO: 12887 - DNA, 23 bp, Artificial Sequence
  Synthetic construct
attgccttaacaataagctcgca

SEQ ID NO: 12888 - DNA, 23 bp, Artificial Sequence
  Synthetic construct
ttgccttaacaataagctcgcag

SEQ ID NO: 12889 - DNA, 23 bp, Artificial Sequence
  Synthetic construct
tgccttaacaataagctcgcagt

SEQ ID NO: 12890 - DNA, 23 bp, Artificial Sequence
  Synthetic construct
gccttaacaataagctcgcagtc

SEQ ID NO: 12891 - DNA, 23 bp, Artificial Sequence
  Synthetic construct
ccttaacaataagctcgcagtcg

SEQ ID NO: 12892 - DNA, 23 bp, Artificial Sequence
  Synthetic construct
cttaacaataagctcgcagtcgg

SEQ ID NO: 12893 - DNA, 23 bp, Artificial Sequence
  Synthetic construct
ttaacaataagctcgcagtcgga

SEQ ID NO: 12894 - DNA, 23 bp, Artificial Sequence
  Synthetic construct
taacaataagctcgcagtcggaa

SEQ ID NO: 12895 - DNA, 23 bp, Artificial Sequence
  Synthetic construct
aacaataagctcgcagtcggaat

SEQ ID NO: 12896 - DNA, 23 bp, Artificial Sequence
  Synthetic construct
acaataagctcgcagtcggaatt

SEQ ID NO: 12897 - DNA, 23 bp, Artificial Sequence
  Synthetic construct
caataagctcgcagtcggaattc

SEQ ID NO: 12898 - DNA, 23 bp, Artificial Sequence
  Synthetic construct
aataagctcgcagtcggaattcg

SEQ ID NO: 12899 - DNA, 23 bp, Artificial Sequence
  Synthetic construct
ataagctcgcagtcggaattcgt

SEQ ID NO: 12900 - DNA, 23 bp, Artificial Sequence
  Synthetic construct
taagctcgcagtcggaattcgta

SEQ ID NO: 12901 - DNA, 23 bp, Artificial Sequence
  Synthetic construct
aagctcgcagtcggaattcgtag

SEQ ID NO: 12902 - DNA, 23 bp, Artificial Sequence
  Synthetic construct
agctcgcagtcggaattcgtagc

SEQ ID NO: 12903 - DNA, 23 bp, Artificial Sequence
  Synthetic construct
gctcgcagtcggaattcgtagcg

SEQ ID NO: 12904 - DNA, 23 bp, Artificial Sequence
  Synthetic construct
ctcgcagtcggaattcgtagcga

SEQ ID NO: 12905 - DNA, 23 bp, Artificial Sequence
  Synthetic construct
tcgcagtcggaattcgtagcgaa

SEQ ID NO: 12906 - DNA, 23 bp, Artificial Sequence
  Synthetic construct
cgcagtcggaattcgtagcgaaa

SEQ ID NO: 12907 - DNA, 23 bp, Artificial Sequence
  Synthetic construct
gcagtcggaattcgtagcgaaaa

SEQ ID NO: 12908 - DNA, 23 bp, Artificial Sequence
  Synthetic construct
cagtcggaattcgtagcgaaaat

SEQ ID NO: 12909 - DNA, 23 bp, Artificial Sequence
  Synthetic construct
agtcggaattcgtagcgaaaatt

SEQ ID NO: 12910 - DNA, 23 bp, Artificial Sequence
  Synthetic construct
gtcggaattcgtagcgaaaattg

SEQ ID NO: 12911 - DNA, 23 bp, Artificial Sequence
  Synthetic construct
tcggaattcgtagcgaaaattgg

SEQ ID NO: 12912 - DNA, 23 bp, Artificial Sequence
  Synthetic construct
cggaattcgtagcgaaaattgga

SEQ ID NO: 12913 - DNA, 23 bp, Artificial Sequence
  Synthetic construct
ggaattcgtagcgaaaattggaa

SEQ ID NO: 12914 - DNA, 23 bp, Artificial Sequence
  Synthetic construct
gaattcgtagcgaaaattggaat

SEQ ID NO: 12915 - DNA, 23 bp, Artificial Sequence
  Synthetic construct
aattcgtagcgaaaattggaatg

SEQ ID NO: 12916 - DNA, 23 bp, Artificial Sequence
  Synthetic construct
attcgtagcgaaaattggaatgg

SEQ ID NO: 12917 - DNA, 23 bp, Artificial Sequence
  Synthetic construct
ttcgtagcgaaaattggaatggt

SEQ ID NO: 12918 - DNA, 23 bp, Artificial Sequence
  Synthetic construct
tcgtagcgaaaattggaatggtt

SEQ ID NO: 12919 - DNA, 23 bp, Artificial Sequence
  Synthetic construct
cgtagcgaaaattggaatggtta

SEQ ID NO: 12920 - DNA, 23 bp, Artificial Sequence
  Synthetic construct
gtagcgaaaattggaatggttag

SEQ ID NO: 12921 - DNA, 23 bp, Artificial Sequence
  Synthetic construct
tagcgaaaattggaatggttagt

SEQ ID NO: 12922 - DNA, 23 bp, Artificial Sequence
  Synthetic construct
agcgaaaattggaatggttagtt

SEQ ID NO: 12923 - DNA, 23 bp, Artificial Sequence
  Synthetic construct
gcgaaaattggaatggttagttc

SEQ ID NO: 12924 - DNA, 23 bp, Artificial Sequence
  Synthetic construct
cgaaaattggaatggttagttcc

SEQ ID NO: 12925 - DNA, 23 bp, Artificial Sequence
  Synthetic construct
gaaaattggaatggttagttcca

SEQ ID NO: 12926 - DNA, 23 bp, Artificial Sequence
  Synthetic construct
aaaattggaatggttagttccat

SEQ ID NO: 12927 - DNA, 23 bp, Artificial Sequence
  Synthetic construct
aaattggaatggttagttccata

SEQ ID NO: 12928 - DNA, 23 bp, Artificial Sequence
  Synthetic construct
aattggaatggttagttccatat

SEQ ID NO: 12929 - DNA, 23 bp, Artificial Sequence
  Synthetic construct
attggaatggttagttccatatt

SEQ ID NO: 12930 - DNA, 23 bp, Artificial Sequence
  Synthetic construct
ttggaatggttagttccatattt

SEQ ID NO: 12931 - DNA, 23 bp, Artificial Sequence
  Synthetic construct
tggaatggttagttccatattta

SEQ ID NO: 12932 - DNA, 23 bp, Artificial Sequence
  Synthetic construct
ggaatggttagttccatatttaa

SEQ ID NO: 12933 - DNA, 23 bp, Artificial Sequence
  Synthetic construct
gaatggttagttccatatttaag

SEQ ID NO: 12934 - DNA, 23 bp, Artificial Sequence
  Synthetic construct
aatggttagttccatatttaagt

SEQ ID NO: 12935 - DNA, 23 bp, Artificial Sequence
  Synthetic construct
atggttagttccatatttaagta

SEQ ID NO: 12936 - DNA, 23 bp, Artificial Sequence
  Synthetic construct
tggttagttccatatttaagtac

SEQ ID NO: 12937 - DNA, 23 bp, Artificial Sequence
  Synthetic construct
ggttagttccatatttaagtacg

SEQ ID NO: 12938 - DNA, 23 bp, Artificial Sequence
  Synthetic construct
gttagttccatatttaagtacga

SEQ ID NO: 12939 - DNA, 23 bp, Artificial Sequence
  Synthetic construct
ttagttccatatttaagtacgaa

SEQ ID NO: 12940 - DNA, 23 bp, Artificial Sequence
  Synthetic construct
tagttccatatttaagtacgaac

SEQ ID NO: 12941 - DNA, 23 bp, Artificial Sequence
  Synthetic construct
agttccatatttaagtacgaacg

SEQ ID NO: 12942 - DNA, 23 bp, Artificial Sequence
  Synthetic construct
gttccatatttaagtacgaacgc

SEQ ID NO: 12943 - DNA, 23 bp, Artificial Sequence
  Synthetic construct
ttccatatttaagtacgaacgcc

SEQ ID NO: 12944 - DNA, 23 bp, Artificial Sequence
  Synthetic construct
tccatatttaagtacgaacgcca

SEQ ID NO: 12945 - DNA, 23 bp, Artificial Sequence
  Synthetic construct
ccatatttaagtacgaacgccat

SEQ ID NO: 12946 - DNA, 23 bp, Artificial Sequence
  Synthetic construct
catatttaagtacgaacgccatg

SEQ ID NO: 12947 - DNA, 23 bp, Artificial Sequence
  Synthetic construct
atatttaagtacgaacgccatgc

SEQ ID NO: 12948 - DNA, 23 bp, Artificial Sequence
  Synthetic construct
tatttaagtacgaacgccatgcg

SEQ ID NO: 12949 - DNA, 23 bp, Artificial Sequence
  Synthetic construct
atttaagtacgaacgccatgcgg

SEQ ID NO: 12950 - DNA, 23 bp, Artificial Sequence
  Synthetic construct
tttaagtacgaacgccatgcggc

SEQ ID NO: 12951 - DNA, 23 bp, Artificial Sequence
  Synthetic construct
ttaagtacgaacgccatgcggct

SEQ ID NO: 12952 - DNA, 23 bp, Artificial Sequence
  Synthetic construct
taagtacgaacgccatgcggcta

SEQ ID NO: 12953 - DNA, 23 bp, Artificial Sequence
  Synthetic construct
aagtacgaacgccatgcggctac

SEQ ID NO: 12954 - DNA, 23 bp, Artificial Sequence
  Synthetic construct
agtacgaacgccatgcggctaca

SEQ ID NO: 12955 - DNA, 23 bp, Artificial Sequence
  Synthetic construct
gtacgaacgccatgcggctacag

SEQ ID NO: 12956 - DNA, 23 bp, Artificial Sequence
  Synthetic construct
tacgaacgccatgcggctacagg

SEQ ID NO: 12957 - DNA, 23 bp, Artificial Sequence
  Synthetic construct
acgaacgccatgcggctacagga

SEQ ID NO: 12958 - DNA, 23 bp, Artificial Sequence
  Synthetic construct
cgaacgccatgcggctacaggaa

SEQ ID NO: 12959 - DNA, 23 bp, Artificial Sequence
  Synthetic construct
gaacgccatgcggctacaggaag

SEQ ID NO: 12960 - DNA, 23 bp, Artificial Sequence
  Synthetic construct
aacgccatgcggctacaggaagc

SEQ ID NO: 12961 - DNA, 23 bp, Artificial Sequence
  Synthetic construct
acgccatgcggctacaggaagct

SEQ ID NO: 12962 - DNA, 23 bp, Artificial Sequence
  Synthetic construct
cgccatgcggctacaggaagctc

SEQ ID NO: 12963 - DNA, 23 bp, Artificial Sequence
  Synthetic construct
gccatgcggctacaggaagctct

SEQ ID NO: 12964 - DNA, 23 bp, Artificial Sequence
  Synthetic construct
ccatgcggctacaggaagctcta

SEQ ID NO: 12965 - DNA, 23 bp, Artificial Sequence
  Synthetic construct
catgcggctacaggaagctctac

SEQ ID NO: 12966 - DNA, 23 bp, Artificial Sequence
  Synthetic construct
atgcggctacaggaagctctaca

SEQ ID NO: 12967 - DNA, 23 bp, Artificial Sequence
  Synthetic construct
tgcggctacaggaagctctacac

SEQ ID NO: 12968 - DNA, 23 bp, Artificial Sequence
  Synthetic construct
gcggctacaggaagctctacacc

SEQ ID NO: 12969 - DNA, 23 bp, Artificial Sequence
  Synthetic construct
cggctacaggaagctctacacca

SEQ ID NO: 12970 - DNA, 23 bp, Artificial Sequence
  Synthetic construct
ggctacaggaagctctacaccac

SEQ ID NO: 12971 - DNA, 23 bp, Artificial Sequence
  Synthetic construct
gctacaggaagctctacaccacc

SEQ ID NO: 12972 - DNA, 23 bp, Artificial Sequence
  Synthetic construct
ctacaggaagctctacaccacca

SEQ ID NO: 12973 - DNA, 23 bp, Artificial Sequence
  Synthetic construct
tacaggaagctctacaccaccaa

SEQ ID NO: 12974 - DNA, 23 bp, Artificial Sequence
  Synthetic construct
acaggaagctctacaccaccaac

SEQ ID NO: 12975 - DNA, 23 bp, Artificial Sequence
  Synthetic construct
caggaagctctacaccaccaaca

SEQ ID NO: 12976 - DNA, 23 bp, Artificial Sequence
  Synthetic construct
aggaagctctacaccaccaacag

SEQ ID NO: 12977 - DNA, 23 bp, Artificial Sequence
  Synthetic construct
ggaagctctacaccaccaacagt

SEQ ID NO: 12978 - DNA, 23 bp, Artificial Sequence
  Synthetic construct
gaagctctacaccaccaacagtc

SEQ ID NO: 12979 - DNA, 23 bp, Artificial Sequence
  Synthetic construct
aagctctacaccaccaacagtct

SEQ ID NO: 12980 - DNA, 23 bp, Artificial Sequence
  Synthetic construct
agctctacaccaccaacagtctg

SEQ ID NO: 12981 - DNA, 23 bp, Artificial Sequence
  Synthetic construct
gctctacaccaccaacagtctgg

SEQ ID NO: 12982 - DNA, 23 bp, Artificial Sequence
  Synthetic construct
ctctacaccaccaacagtctggg

SEQ ID NO: 12983 - DNA, 23 bp, Artificial Sequence
  Synthetic construct
tctacaccaccaacagtctgggt

SEQ ID NO: 12984 - DNA, 23 bp, Artificial Sequence
  Synthetic construct
ctacaccaccaacagtctgggtt

SEQ ID NO: 12985 - DNA, 23 bp, Artificial Sequence
  Synthetic construct
tacaccaccaacagtctgggttg

SEQ ID NO: 12986 - DNA, 23 bp, Artificial Sequence
  Synthetic construct
acaccaccaacagtctgggttgc

SEQ ID NO: 12987 - DNA, 23 bp, Artificial Sequence
  Synthetic construct
caccaccaacagtctgggttgcc

SEQ ID NO: 12988 - DNA, 23 bp, Artificial Sequence
  Synthetic construct
accaccaacagtctgggttgcca

SEQ ID NO: 12989 - DNA, 23 bp, Artificial Sequence
  Synthetic construct
ccaccaacagtctgggttgccac

SEQ ID NO: 12990 - DNA, 23 bp, Artificial Sequence
  Synthetic construct
caccaacagtctgggttgccact

SEQ ID NO: 12991 - DNA, 23 bp, Artificial Sequence
  Synthetic construct
accaacagtctgggttgccactt

SEQ ID NO: 12992 - DNA, 23 bp, Artificial Sequence
  Synthetic construct
ccaacagtctgggttgccacttt

SEQ ID NO: 12993 - DNA, 23 bp, Artificial Sequence
  Synthetic construct
caacagtctgggttgccacttta

SEQ ID NO: 12994 - DNA, 23 bp, Artificial Sequence
  Synthetic construct
aacagtctgggttgccactttag

SEQ ID NO: 12995 - DNA, 23 bp, Artificial Sequence
  Synthetic construct
acagtctgggttgccactttagg

SEQ ID NO: 12996 - DNA, 23 bp, Artificial Sequence
  Synthetic construct
cagtctgggttgccactttaggc

SEQ ID NO: 12997 - DNA, 23 bp, Artificial Sequence
  Synthetic construct
agtctgggttgccactttaggca

SEQ ID NO: 12998 - DNA, 23 bp, Artificial Sequence
  Synthetic construct
gtctgggttgccactttaggcac

SEQ ID NO: 12999 - DNA, 23 bp, Artificial Sequence
  Synthetic construct
tctgggttgccactttaggcacc

SEQ ID NO: 13000 - DNA, 23 bp, Artificial Sequence
  Synthetic construct
ctgggttgccactttaggcacct

SEQ ID NO: 13001 - DNA, 23 bp, Artificial Sequence
  Synthetic construct
tgggttgccactttaggcacctc

SEQ ID NO: 13002 - DNA, 23 bp, Artificial Sequence
  Synthetic construct
gggttgccactttaggcacctcg

SEQ ID NO: 13003 - DNA, 23 bp, Artificial Sequence
  Synthetic construct
ggttgccactttaggcacctcga

SEQ ID NO: 13004 - DNA, 23 bp, Artificial Sequence
  Synthetic construct
gttgccactttaggcacctcgac

SEQ ID NO: 13005 - DNA, 23 bp, Artificial Sequence
  Synthetic construct
ttgccactttaggcacctcgact

SEQ ID NO: 13006 - DNA, 23 bp, Artificial Sequence
  Synthetic construct
tgccactttaggcacctcgactt

SEQ ID NO: 13007 - DNA, 23 bp, Artificial Sequence
  Synthetic construct
gccactttaggcacctcgacttt

SEQ ID NO: 13008 - DNA, 23 bp, Artificial Sequence
  Synthetic construct
ccactttaggcacctcgactttg

SEQ ID NO: 13009 - DNA, 23 bp, Artificial Sequence
  Synthetic construct
cactttaggcacctcgactttga

SEQ ID NO: 13010 - DNA, 23 bp, Artificial Sequence
  Synthetic construct
actttaggcacctcgactttgat

SEQ ID NO: 13011 - DNA, 23 bp, Artificial Sequence
  Synthetic construct
ctttaggcacctcgactttgatg

SEQ ID NO: 13012 - DNA, 23 bp, Artificial Sequence
  Synthetic construct
tttaggcacctcgactttgatgg

SEQ ID NO: 13013 - DNA, 23 bp, Artificial Sequence
  Synthetic construct
ttaggcacctcgactttgatggt

SEQ ID NO: 13014 - DNA, 23 bp, Artificial Sequence
  Synthetic construct
taggcacctcgactttgatggtg

SEQ ID NO: 13015 - DNA, 23 bp, Artificial Sequence
  Synthetic construct
aggcacctcgactttgatggtgt

SEQ ID NO: 13016 - DNA, 23 bp, Artificial Sequence
  Synthetic construct
ggcacctcgactttgatggtgta

SEQ ID NO: 13017 - DNA, 23 bp, Artificial Sequence
  Synthetic construct
gcacctcgactttgatggtgtat

SEQ ID NO: 13018 - DNA, 23 bp, Artificial Sequence
  Synthetic construct
cacctcgactttgatggtgtatt

SEQ ID NO: 13019 - DNA, 23 bp, Artificial Sequence
  Synthetic construct
acctcgactttgatggtgtattt

SEQ ID NO: 13020 - DNA, 23 bp, Artificial Sequence
  Synthetic construct
cctcgactttgatggtgtatttg

SEQ ID NO: 13021 - DNA, 23 bp, Artificial Sequence
  Synthetic construct
ctcgactttgatggtgtatttgc

SEQ ID NO: 13022 - DNA, 23 bp, Artificial Sequence
  Synthetic construct
tcgactttgatggtgtatttgcg

SEQ ID NO: 13023 - DNA, 23 bp, Artificial Sequence
  Synthetic construct
cgactttgatggtgtatttgcga

SEQ ID NO: 13024 - DNA, 23 bp, Artificial Sequence
  Synthetic construct
gactttgatggtgtatttgcgat

SEQ ID NO: 13025 - DNA, 23 bp, Artificial Sequence
  Synthetic construct
actttgatggtgtatttgcgatt

SEQ ID NO: 13026 - DNA, 23 bp, Artificial Sequence
  Synthetic construct
ctttgatggtgtatttgcgattc

SEQ ID NO: 13027 - DNA, 23 bp, Artificial Sequence
  Synthetic construct
tttgatggtgtatttgcgattct

SEQ ID NO: 13028 - DNA, 23 bp, Artificial Sequence
  Synthetic construct
ttgatggtgtatttgcgattctg

SEQ ID NO: 13029 - DNA, 23 bp, Artificial Sequence
  Synthetic construct
tgatggtgtatttgcgattctgc

SEQ ID NO: 13030 - DNA, 23 bp, Artificial Sequence
  Synthetic construct
gatggtgtatttgcgattctgcg

SEQ ID NO: 13031 - DNA, 23 bp, Artificial Sequence
  Synthetic construct
atggtgtatttgcgattctgcgc

SEQ ID NO: 13032 - DNA, 23 bp, Artificial Sequence
  Synthetic construct
tggtgtatttgcgattctgcgca

SEQ ID NO: 13033 - DNA, 23 bp, Artificial Sequence
  Synthetic construct
ggtgtatttgcgattctgcgcag

SEQ ID NO: 13034 - DNA, 23 bp, Artificial Sequence
  Synthetic construct
gtgtatttgcgattctgcgcaga

SEQ ID NO: 13035 - DNA, 23 bp, Artificial Sequence
  Synthetic construct
tgtatttgcgattctgcgcagag

SEQ ID NO: 13036 - DNA, 23 bp, Artificial Sequence
  Synthetic construct
gtatttgcgattctgcgcagagc

SEQ ID NO: 13037 - DNA, 23 bp, Artificial Sequence
  Synthetic construct
tatttgcgattctgcgcagagct

SEQ ID NO: 13038 - DNA, 23 bp, Artificial Sequence
  Synthetic construct
atttgcgattctgcgcagagctc

SEQ ID NO: 13039 - DNA, 23 bp, Artificial Sequence
  Synthetic construct
tttgcgattctgcgcagagctct

SEQ ID NO: 13040 - DNA, 23 bp, Artificial Sequence
  Synthetic construct
ttgcgattctgcgcagagctctg

SEQ ID NO: 13041 - DNA, 23 bp, Artificial Sequence
  Synthetic construct
tgcgattctgcgcagagctctga

SEQ ID NO: 13042 - DNA, 23 bp, Artificial Sequence
  Synthetic construct
gcgattctgcgcagagctctgac

SEQ ID NO: 13043 - DNA, 23 bp, Artificial Sequence
  Synthetic construct
cgattctgcgcagagctctgacg

SEQ ID NO: 13044 - DNA, 23 bp, Artificial Sequence
  Synthetic construct
gattctgcgcagagctctgacga

SEQ ID NO: 13045 - DNA, 23 bp, Artificial Sequence
  Synthetic construct
attctgcgcagagctctgacgaa

SEQ ID NO: 13046 - DNA, 23 bp, Artificial Sequence
  Synthetic construct
ttctgcgcagagctctgacgaac

SEQ ID NO: 13047 - DNA, 23 bp, Artificial Sequence
  Synthetic construct
tctgcgcagagctctgacgaacg

SEQ ID NO: 13048 - DNA, 23 bp, Artificial Sequence
  Synthetic construct
ctgcgcagagctctgacgaacgc

SEQ ID NO: 13049 - DNA, 23 bp, Artificial Sequence
  Synthetic construct
tgcgcagagctctgacgaacgct

SEQ ID NO: 13050 - DNA, 23 bp, Artificial Sequence
  Synthetic construct
gcgcagagctctgacgaacgcta

SEQ ID NO: 13051 - DNA, 23 bp, Artificial Sequence
  Synthetic construct
cgcagagctctgacgaacgctac

SEQ ID NO: 13052 - DNA, 23 bp, Artificial Sequence
  Synthetic construct
gcagagctctgacgaacgctaca

SEQ ID NO: 13053 - DNA, 23 bp, Artificial Sequence
  Synthetic construct
cagagctctgacgaacgctacag

SEQ ID NO: 13054 - DNA, 23 bp, Artificial Sequence
  Synthetic construct
agagctctgacgaacgctacagg

SEQ ID NO: 13055 - DNA, 23 bp, Artificial Sequence
  Synthetic construct
gagctctgacgaacgctacaggt

SEQ ID NO: 13056 - DNA, 23 bp, Artificial Sequence
  Synthetic construct
agctctgacgaacgctacaggtt

SEQ ID NO: 13057 - DNA, 23 bp, Artificial Sequence
  Synthetic construct
gctctgacgaacgctacaggtta

SEQ ID NO: 13058 - DNA, 23 bp, Artificial Sequence
  Synthetic construct
ctctgacgaacgctacaggttac

SEQ ID NO: 13059 - DNA, 23 bp, Artificial Sequence
  Synthetic construct
tctgacgaacgctacaggttact

SEQ ID NO: 13060 - DNA, 23 bp, Artificial Sequence
  Synthetic construct
ctgacgaacgctacaggttactt

SEQ ID NO: 13061 - DNA, 23 bp, Artificial Sequence
  Synthetic construct
tgacgaacgctacaggttacttt

SEQ ID NO: 13062 - DNA, 23 bp, Artificial Sequence
  Synthetic construct
gacgaacgctacaggttactttg

SEQ ID NO: 13063 - DNA, 23 bp, Artificial Sequence
  Synthetic construct
acgaacgctacaggttactttgt

SEQ ID NO: 13064 - DNA, 23 bp, Artificial Sequence
  Synthetic construct
cgaacgctacaggttactttgta

SEQ ID NO: 13065 - DNA, 23 bp, Artificial Sequence
  Synthetic construct
gaacgctacaggttactttgtaa

SEQ ID NO: 13066 - DNA, 23 bp, Artificial Sequence
  Synthetic construct
aacgctacaggttactttgtaag

SEQ ID NO: 13067 - DNA, 23 bp, Artificial Sequence
  Synthetic construct
acgctacaggttactttgtaagc

SEQ ID NO: 13068 - DNA, 23 bp, Artificial Sequence
  Synthetic construct
cgctacaggttactttgtaagcc

SEQ ID NO: 13069 - DNA, 23 bp, Artificial Sequence
  Synthetic construct
gctacaggttactttgtaagcct

SEQ ID NO: 13070 - DNA, 23 bp, Artificial Sequence
  Synthetic construct
ctacaggttactttgtaagcctg

SEQ ID NO: 13071 - DNA, 23 bp, Artificial Sequence
  Synthetic construct
tacaggttactttgtaagcctgt

SEQ ID NO: 13072 - DNA, 23 bp, Artificial Sequence
  Synthetic construct
acaggttactttgtaagcctgtg

SEQ ID NO: 13073 - DNA, 23 bp, Artificial Sequence
  Synthetic construct
caggttactttgtaagcctgtga

SEQ ID NO: 13074 - DNA, 23 bp, Artificial Sequence
  Synthetic construct
aggttactttgtaagcctgtgaa

SEQ ID NO: 13075 - DNA, 23 bp, Artificial Sequence
  Synthetic construct
ggttactttgtaagcctgtgaac

SEQ ID NO: 13076 - DNA, 23 bp, Artificial Sequence
  Synthetic construct
gttactttgtaagcctgtgaacg

SEQ ID NO: 13077 - DNA, 23 bp, Artificial Sequence
  Synthetic construct
ttactttgtaagcctgtgaacgc

SEQ ID NO: 13078 - DNA, 23 bp, Artificial Sequence
  Synthetic construct
tactttgtaagcctgtgaacgcg

SEQ ID NO: 13079 - DNA, 23 bp, Artificial Sequence
  Synthetic construct
actttgtaagcctgtgaacgcga

SEQ ID NO: 13080 - DNA, 23 bp, Artificial Sequence
  Synthetic construct
ctttgtaagcctgtgaacgcgag

SEQ ID NO: 13081 - DNA, 23 bp, Artificial Sequence
  Synthetic construct
tttgtaagcctgtgaacgcgagt

SEQ ID NO: 13082 - DNA, 23 bp, Artificial Sequence
  Synthetic construct
ttgtaagcctgtgaacgcgagtt

SEQ ID NO: 13083 - DNA, 23 bp, Artificial Sequence
  Synthetic construct
tgtaagcctgtgaacgcgagtta

SEQ ID NO: 13084 - DNA, 23 bp, Artificial Sequence
  Synthetic construct
gtaagcctgtgaacgcgagttag

SEQ ID NO: 13085 - DNA, 23 bp, Artificial Sequence
  Synthetic construct
taagcctgtgaacgcgagttaga

SEQ ID NO: 13086 - DNA, 23 bp, Artificial Sequence
  Synthetic construct
aagcctgtgaacgcgagttagag

SEQ ID NO: 13087 - DNA, 23 bp, Artificial Sequence
  Synthetic construct
agcctgtgaacgcgagttagagc

SEQ ID NO: 13088 - DNA, 23 bp, Artificial Sequence
  Synthetic construct
gcctgtgaacgcgagttagagct

SEQ ID NO: 13089 - DNA, 23 bp, Artificial Sequence
  Synthetic construct
cctgtgaacgcgagttagagctg

SEQ ID NO: 13090 - DNA, 23 bp, Artificial Sequence
  Synthetic construct
ctgtgaacgcgagttagagctga

SEQ ID NO: 13091 - DNA, 23 bp, Artificial Sequence
  Synthetic construct
tgtgaacgcgagttagagctgat

SEQ ID NO: 13092 - DNA, 23 bp, Artificial Sequence
  Synthetic construct
gtgaacgcgagttagagctgatc

SEQ ID NO: 13093 - DNA, 23 bp, Artificial Sequence
  Synthetic construct
tgaacgcgagttagagctgatcc

SEQ ID NO: 13094 - DNA, 23 bp, Artificial Sequence
  Synthetic construct
gaacgcgagttagagctgatcca

SEQ ID NO: 13095 - DNA, 23 bp, Artificial Sequence
  Synthetic construct
aacgcgagttagagctgatccat

SEQ ID NO: 13096 - DNA, 23 bp, Artificial Sequence
  Synthetic construct
acgcgagttagagctgatccatt

SEQ ID NO: 13097 - DNA, 23 bp, Artificial Sequence
  Synthetic construct
cgcgagttagagctgatccattc

SEQ ID NO: 13098 - DNA, 23 bp, Artificial Sequence
  Synthetic construct
gcgagttagagctgatccattca

SEQ ID NO: 13099 - DNA, 23 bp, Artificial Sequence
  Synthetic construct
cgagttagagctgatccattcag

SEQ ID NO: 13100 - DNA, 23 bp, Artificial Sequence
  Synthetic construct
gagttagagctgatccattcagc

SEQ ID NO: 13101 - DNA, 23 bp, Artificial Sequence
  Synthetic construct
agttagagctgatccattcagcg

SEQ ID NO: 13102 - DNA, 23 bp, Artificial Sequence
  Synthetic construct
gttagagctgatccattcagcga

SEQ ID NO: 13103 - DNA, 23 bp, Artificial Sequence
  Synthetic construct
ttagagctgatccattcagcgac

SEQ ID NO: 13104 - DNA, 23 bp, Artificial Sequence
  Synthetic construct
tagagctgatccattcagcgacc

SEQ ID NO: 13105 - DNA, 23 bp, Artificial Sequence
  Synthetic construct
agagctgatccattcagcgaccc

SEQ ID NO: 13106 - DNA, 23 bp, Artificial Sequence
  Synthetic construct
gagctgatccattcagcgacccc

SEQ ID NO: 13107 - DNA, 23 bp, Artificial Sequence
  Synthetic construct
agctgatccattcagcgaccccg

SEQ ID NO: 13108 - DNA, 23 bp, Artificial Sequence
  Synthetic construct
gctgatccattcagcgaccccgt

SEQ ID NO: 13109 - DNA, 23 bp, Artificial Sequence
  Synthetic construct
ctgatccattcagcgaccccgtt

SEQ ID NO: 13110 - DNA, 23 bp, Artificial Sequence
  Synthetic construct
tgatccattcagcgaccccgtta

SEQ ID NO: 13111 - DNA, 23 bp, Artificial Sequence
  Synthetic construct
gatccattcagcgaccccgttag

SEQ ID NO: 13112 - DNA, 23 bp, Artificial Sequence
  Synthetic construct
atccattcagcgaccccgttagc

SEQ ID NO: 13113 - DNA, 23 bp, Artificial Sequence
  Synthetic construct
tccattcagcgaccccgttagcg

SEQ ID NO: 13114 - DNA, 23 bp, Artificial Sequence
  Synthetic construct
ccattcagcgaccccgttagcga

SEQ ID NO: 13115 - DNA, 23 bp, Artificial Sequence
  Synthetic construct
cattcagcgaccccgttagcgaa

SEQ ID NO: 13116 - DNA, 23 bp, Artificial Sequence
  Synthetic construct
attcagcgaccccgttagcgaag

SEQ ID NO: 13117 - DNA, 23 bp, Artificial Sequence
  Synthetic construct
ttcagcgaccccgttagcgaagt

SEQ ID NO: 13118 - DNA, 23 bp, Artificial Sequence
  Synthetic construct
tcagcgaccccgttagcgaagtt

SEQ ID NO: 13119 - DNA, 23 bp, Artificial Sequence
  Synthetic construct
cagcgaccccgttagcgaagttg

SEQ ID NO: 13120 - DNA, 23 bp, Artificial Sequence
  Synthetic construct
agcgaccccgttagcgaagttgc

SEQ ID NO: 13121 - DNA, 23 bp, Artificial Sequence
  Synthetic construct
gcgaccccgttagcgaagttgct

SEQ ID NO: 13122 - DNA, 23 bp, Artificial Sequence
  Synthetic construct
cgaccccgttagcgaagttgctt

SEQ ID NO: 13123 - DNA, 23 bp, Artificial Sequence
  Synthetic construct
gaccccgttagcgaagttgcttg

SEQ ID NO: 13124 - DNA, 23 bp, Artificial Sequence
  Synthetic construct
accccgttagcgaagttgcttgg

SEQ ID NO: 13125 - DNA, 23 bp, Artificial Sequence
  Synthetic construct
ccccgttagcgaagttgcttggg

SEQ ID NO: 13126 - DNA, 23 bp, Artificial Sequence
  Synthetic construct
cccgttagcgaagttgcttgggg

SEQ ID NO: 13127 - DNA, 23 bp, Artificial Sequence
  Synthetic construct
ccgttagcgaagttgcttggggc

SEQ ID NO: 13128 - DNA, 23 bp, Artificial Sequence
  Synthetic construct
cgttagcgaagttgcttggggcg

SEQ ID NO: 13129 - DNA, 23 bp, Artificial Sequence
  Synthetic construct
gttagcgaagttgcttggggcga

SEQ ID NO: 13130 - DNA, 23 bp, Artificial Sequence
  Synthetic construct
ttagcgaagttgcttggggcgac

SEQ ID NO: 13131 - DNA, 23 bp, Artificial Sequence
  Synthetic construct
tagcgaagttgcttggggcgaca

SEQ ID NO: 13132 - DNA, 23 bp, Artificial Sequence
  Synthetic construct
agcgaagttgcttggggcgacag

SEQ ID NO: 13133 - DNA, 23 bp, Artificial Sequence
  Synthetic construct
gcgaagttgcttggggcgacagt

SEQ ID NO: 13134 - DNA, 23 bp, Artificial Sequence
  Synthetic construct
cgaagttgcttggggcgacagtc

SEQ ID NO: 13135 - DNA, 23 bp, Artificial Sequence
  Synthetic construct
gaagttgcttggggcgacagtca

SEQ ID NO: 13136 - DNA, 23 bp, Artificial Sequence
  Synthetic construct
aagttgcttggggcgacagtcac

SEQ ID NO: 13137 - DNA, 23 bp, Artificial Sequence
  Synthetic construct
agttgcttggggcgacagtcacg

SEQ ID NO: 13138 - DNA, 23 bp, Artificial Sequence
  Synthetic construct
gttgcttggggcgacagtcacgt

SEQ ID NO: 13139 - DNA, 23 bp, Artificial Sequence
  Synthetic construct
ttgcttggggcgacagtcacgtc

SEQ ID NO: 13140 - DNA, 23 bp, Artificial Sequence
  Synthetic construct
tgcttggggcgacagtcacgtcg

SEQ ID NO: 13141 - DNA, 23 bp, Artificial Sequence
  Synthetic construct
gcttggggcgacagtcacgtcgc

SEQ ID NO: 13142 - DNA, 23 bp, Artificial Sequence
  Synthetic construct
cttggggcgacagtcacgtcgcc

SEQ ID NO: 13143 - DNA, 23 bp, Artificial Sequence
  Synthetic construct
ttggggcgacagtcacgtcgcca

SEQ ID NO: 13144 - DNA, 23 bp, Artificial Sequence
  Synthetic construct
tggggcgacagtcacgtcgccag

SEQ ID NO: 13145 - DNA, 23 bp, Artificial Sequence
  Synthetic construct
ggggcgacagtcacgtcgccagt

SEQ ID NO: 13146 - DNA, 23 bp, Artificial Sequence
  Synthetic construct
gggcgacagtcacgtcgccagtt

SEQ ID NO: 13147 - DNA, 23 bp, Artificial Sequence
  Synthetic construct
ggcgacagtcacgtcgccagttc

SEQ ID NO: 13148 - DNA, 23 bp, Artificial Sequence
  Synthetic construct
gcgacagtcacgtcgccagttcc

SEQ ID NO: 13149 - DNA, 23 bp, Artificial Sequence
  Synthetic construct
cgacagtcacgtcgccagttccg

SEQ ID NO: 13150 - DNA, 23 bp, Artificial Sequence
  Synthetic construct
gacagtcacgtcgccagttccgc

SEQ ID NO: 13151 - DNA, 23 bp, Artificial Sequence
  Synthetic construct
acagtcacgtcgccagttccgcc

SEQ ID NO: 13152 - DNA, 23 bp, Artificial Sequence
  Synthetic construct
cagtcacgtcgccagttccgcca

SEQ ID NO: 13153 - DNA, 23 bp, Artificial Sequence
  Synthetic construct
agtcacgtcgccagttccgccat

SEQ ID NO: 13154 - DNA, 23 bp, Artificial Sequence
  Synthetic construct
gtcacgtcgccagttccgccatt

SEQ ID NO: 13155 - DNA, 23 bp, Artificial Sequence
  Synthetic construct
tcacgtcgccagttccgccattg

SEQ ID NO: 13156 - DNA, 23 bp, Artificial Sequence
  Synthetic construct
cacgtcgccagttccgccattgt

SEQ ID NO: 13157 - DNA, 23 bp, Artificial Sequence
  Synthetic construct
acgtcgccagttccgccattgtc

SEQ ID NO: 13158 - DNA, 23 bp, Artificial Sequence
  Synthetic construct
cgtcgccagttccgccattgtcg

SEQ ID NO: 13159 - DNA, 23 bp, Artificial Sequence
  Synthetic construct
gtcgccagttccgccattgtcga

SEQ ID NO: 13160 - DNA, 23 bp, Artificial Sequence
  Synthetic construct
tcgccagttccgccattgtcgac

SEQ ID NO: 13161 - DNA, 23 bp, Artificial Sequence
  Synthetic construct
cgccagttccgccattgtcgacg

SEQ ID NO: 13162 - DNA, 23 bp, Artificial Sequence
  Synthetic construct
gccagttccgccattgtcgacga

SEQ ID NO: 13163 - DNA, 23 bp, Artificial Sequence
  Synthetic construct
ccagttccgccattgtcgacgag

SEQ ID NO: 13164 - DNA, 23 bp, Artificial Sequence
  Synthetic construct
cagttccgccattgtcgacgaga

SEQ ID NO: 13165 - DNA, 23 bp, Artificial Sequence
  Synthetic construct
agttccgccattgtcgacgagaa

SEQ ID NO: 13166 - DNA, 23 bp, Artificial Sequence
  Synthetic construct
gttccgccattgtcgacgagaac

SEQ ID NO: 13167 - DNA, 23 bp, Artificial Sequence
  Synthetic construct
ttccgccattgtcgacgagaacg

SEQ ID NO: 13168 - DNA, 23 bp, Artificial Sequence
  Synthetic construct
tccgccattgtcgacgagaacga

SEQ ID NO: 13169 - DNA, 23 bp, Artificial Sequence
  Synthetic construct
ccgccattgtcgacgagaacgaa

SEQ ID NO: 13170 - DNA, 23 bp, Artificial Sequence
  Synthetic construct
cgccattgtcgacgagaacgaac

SEQ ID NO: 13171 - DNA, 23 bp, Artificial Sequence
  Synthetic construct
gccattgtcgacgagaacgaact

SEQ ID NO: 13172 - DNA, 23 bp, Artificial Sequence
  Synthetic construct
ccattgtcgacgagaacgaactg

SEQ ID NO: 13173 - DNA, 23 bp, Artificial Sequence
  Synthetic construct
cattgtcgacgagaacgaactga

SEQ ID NO: 13174 - DNA, 23 bp, Artificial Sequence
  Synthetic construct
attgtcgacgagaacgaactgag

SEQ ID NO: 13175 - DNA, 23 bp, Artificial Sequence
  Synthetic construct
ttgtcgacgagaacgaactgagt

SEQ ID NO: 13176 - DNA, 23 bp, Artificial Sequence
  Synthetic construct
tgtcgacgagaacgaactgagta

SEQ ID NO: 13177 - DNA, 23 bp, Artificial Sequence
  Synthetic construct
gtcgacgagaacgaactgagtaa

SEQ ID NO: 13178 - DNA, 23 bp, Artificial Sequence
  Synthetic construct
tcgacgagaacgaactgagtaaa

SEQ ID NO: 13179 - DNA, 23 bp, Artificial Sequence
  Synthetic construct
cgacgagaacgaactgagtaaag

SEQ ID NO: 13180 - DNA, 23 bp, Artificial Sequence
  Synthetic construct
gacgagaacgaactgagtaaagt

SEQ ID NO: 13181 - DNA, 23 bp, Artificial Sequence
  Synthetic construct
acgagaacgaactgagtaaagtt

SEQ ID NO: 13182 - DNA, 23 bp, Artificial Sequence
  Synthetic construct
cgagaacgaactgagtaaagtta

SEQ ID NO: 13183 - DNA, 23 bp, Artificial Sequence
  Synthetic construct
gagaacgaactgagtaaagttag

SEQ ID NO: 13184 - DNA, 23 bp, Artificial Sequence
  Synthetic construct
agaacgaactgagtaaagttaga

SEQ ID NO: 13185 - DNA, 23 bp, Artificial Sequence
  Synthetic construct
gaacgaactgagtaaagttagaa

SEQ ID NO: 13186 - DNA, 23 bp, Artificial Sequence
  Synthetic construct
aacgaactgagtaaagttagaag

SEQ ID NO: 13187 - DNA, 23 bp, Artificial Sequence
  Synthetic construct
acgaactgagtaaagttagaagc

SEQ ID NO: 13188 - DNA, 23 bp, Artificial Sequence
  Synthetic construct
cgaactgagtaaagttagaagcc

SEQ ID NO: 13189 - DNA, 23 bp, Artificial Sequence
  Synthetic construct
gaactgagtaaagttagaagcca

SEQ ID NO: 13190 - DNA, 23 bp, Artificial Sequence
  Synthetic construct
aactgagtaaagttagaagccat

SEQ ID NO: 13191 - DNA, 23 bp, Artificial Sequence
  Synthetic construct
actgagtaaagttagaagccatg

SEQ ID NO: 13192 - DNA, 23 bp, Artificial Sequence
  Synthetic construct
ctgagtaaagttagaagccatgc

SEQ ID NO: 13193 - DNA, 23 bp, Artificial Sequence
  Synthetic construct
tgagtaaagttagaagccatgct

SEQ ID NO: 13194 - DNA, 23 bp, Artificial Sequence
  Synthetic construct
gagtaaagttagaagccatgctt

SEQ ID NO: 13195 - DNA, 23 bp, Artificial Sequence
  Synthetic construct
agtaaagttagaagccatgcttc

SEQ ID NO: 13196 - DNA, 23 bp, Artificial Sequence
  Synthetic construct
gtaaagttagaagccatgcttca

SEQ ID NO: 13197 - DNA, 23 bp, Artificial Sequence
  Synthetic construct
taaagttagaagccatgcttcaa

SEQ ID NO: 13198 - DNA, 23 bp, Artificial Sequence
  Synthetic construct
aaagttagaagccatgcttcaaa

SEQ ID NO: 13199 - DNA, 23 bp, Artificial Sequence
  Synthetic construct
aagttagaagccatgcttcaaac

SEQ ID NO: 13200 - DNA, 23 bp, Artificial Sequence
  Synthetic construct
agttagaagccatgcttcaaact

SEQ ID NO: 13201 - DNA, 23 bp, Artificial Sequence
  Synthetic construct
gttagaagccatgcttcaaactc

SEQ ID NO: 13202 - DNA, 23 bp, Artificial Sequence
  Synthetic construct
ttagaagccatgcttcaaactcc

SEQ ID NO: 13203 - DNA, 23 bp, Artificial Sequence
  Synthetic construct
tagaagccatgcttcaaactccg

SEQ ID NO: 13204 - DNA, 23 bp, Artificial Sequence
  Synthetic construct
agaagccatgcttcaaactccgg

SEQ ID NO: 13205 - DNA, 23 bp, Artificial Sequence
  Synthetic construct
gaagccatgcttcaaactccggt

SEQ ID NO: 13206 - DNA, 23 bp, Artificial Sequence
  Synthetic construct
aagccatgcttcaaactccggtt

SEQ ID NO: 13207 - DNA, 23 bp, Artificial Sequence
  Synthetic construct
agccatgcttcaaactccggttg

SEQ ID NO: 13208 - DNA, 23 bp, Artificial Sequence
  Synthetic construct
gccatgcttcaaactccggttga

SEQ ID NO: 13209 - DNA, 23 bp, Artificial Sequence
  Synthetic construct
ccatgcttcaaactccggttgag

SEQ ID NO: 13210 - DNA, 23 bp, Artificial Sequence
  Synthetic construct
catgcttcaaactccggttgagg

SEQ ID NO: 13211 - DNA, 23 bp, Artificial Sequence
  Synthetic construct
atgcttcaaactccggttgaggg

SEQ ID NO: 13212 - DNA, 23 bp, Artificial Sequence
  Synthetic construct
tgcttcaaactccggttgagggc

SEQ ID NO: 13213 - DNA, 23 bp, Artificial Sequence
  Synthetic construct
gcttcaaactccggttgagggct

SEQ ID NO: 13214 - DNA, 23 bp, Artificial Sequence
  Synthetic construct
cttcaaactccggttgagggctc

SEQ ID NO: 13215 - DNA, 23 bp, Artificial Sequence
  Synthetic construct
ttcaaactccggttgagggctct

SEQ ID NO: 13216 - DNA, 23 bp, Artificial Sequence
  Synthetic construct
tcaaactccggttgagggctcta

SEQ ID NO: 13217 - DNA, 23 bp, Artificial Sequence
  Synthetic construct
caaactccggttgagggctctat

SEQ ID NO: 13218 - DNA, 23 bp, Artificial Sequence
  Synthetic construct
aaactccggttgagggctctatc

SEQ ID NO: 13219 - DNA, 23 bp, Artificial Sequence
  Synthetic construct
aactccggttgagggctctatct

SEQ ID NO: 13220 - DNA, 23 bp, Artificial Sequence
  Synthetic construct
actccggttgagggctctatcta

SEQ ID NO: 13221 - DNA, 23 bp, Artificial Sequence
  Synthetic construct
ctccggttgagggctctatctag

SEQ ID NO: 13222 - DNA, 23 bp, Artificial Sequence
  Synthetic construct
tccggttgagggctctatctaga

SEQ ID NO: 13223 - DNA, 23 bp, Artificial Sequence
  Synthetic construct
ccggttgagggctctatctagag

SEQ ID NO: 13224 - DNA, 23 bp, Artificial Sequence
  Synthetic construct
cggttgagggctctatctagaga

SEQ ID NO: 13225 - DNA, 23 bp, Artificial Sequence
  Synthetic construct
ggttgagggctctatctagagag

SEQ ID NO: 13226 - DNA, 23 bp, Artificial Sequence
  Synthetic construct
gttgagggctctatctagagagc

SEQ ID NO: 13227 - DNA, 23 bp, Artificial Sequence
  Synthetic construct
ttgagggctctatctagagagcc

SEQ ID NO: 13228 - DNA, 23 bp, Artificial Sequence
  Synthetic construct
tgagggctctatctagagagccg

SEQ ID NO: 13229 - DNA, 23 bp, Artificial Sequence
  Synthetic construct
gagggctctatctagagagccgt

SEQ ID NO: 13230 - DNA, 23 bp, Artificial Sequence
  Synthetic construct
agggctctatctagagagccgtt

SEQ ID NO: 13231 - DNA, 23 bp, Artificial Sequence
  Synthetic construct
gggctctatctagagagccgttg

SEQ ID NO: 13232 - DNA, 23 bp, Artificial Sequence
  Synthetic construct
ggctctatctagagagccgttgc

SEQ ID NO: 13233 - DNA, 23 bp, Artificial Sequence
  Synthetic construct
gctctatctagagagccgttgcc

SEQ ID NO: 13234 - DNA, 23 bp, Artificial Sequence
  Synthetic construct
ctctatctagagagccgttgcct

SEQ ID NO: 13235 - DNA, 23 bp, Artificial Sequence
  Synthetic construct
tctatctagagagccgttgcctg

SEQ ID NO: 13236 - DNA, 23 bp, Artificial Sequence
  Synthetic construct
ctatctagagagccgttgcctga

SEQ ID NO: 13237 - DNA, 23 bp, Artificial Sequence
  Synthetic construct
tatctagagagccgttgcctgat

SEQ ID NO: 13238 - DNA, 23 bp, Artificial Sequence
  Synthetic construct
atctagagagccgttgcctgatt

SEQ ID NO: 13239 - DNA, 23 bp, Artificial Sequence
  Synthetic construct
tctagagagccgttgcctgatta

SEQ ID NO: 13240 - DNA, 23 bp, Artificial Sequence
  Synthetic construct
ctagagagccgttgcctgattaa

SEQ ID NO: 13241 - DNA, 23 bp, Artificial Sequence
  Synthetic construct
tagagagccgttgcctgattaat

SEQ ID NO: 13242 - DNA, 23 bp, Artificial Sequence
  Synthetic construct
agagagccgttgcctgattaatg

SEQ ID NO: 13243 - DNA, 23 bp, Artificial Sequence
  Synthetic construct
gagagccgttgcctgattaatgc

SEQ ID NO: 13244 - DNA, 23 bp, Artificial Sequence
  Synthetic construct
agagccgttgcctgattaatgct

SEQ ID NO: 13245 - DNA, 23 bp, Artificial Sequence
  Synthetic construct
gagccgttgcctgattaatgcta

SEQ ID NO: 13246 - DNA, 23 bp, Artificial Sequence
  Synthetic construct
agccgttgcctgattaatgctaa

SEQ ID NO: 13247 - DNA, 23 bp, Artificial Sequence
  Synthetic construct
gccgttgcctgattaatgctaac

SEQ ID NO: 13248 - DNA, 23 bp, Artificial Sequence
  Synthetic construct
ccgttgcctgattaatgctaacg

SEQ ID NO: 13249 - DNA, 23 bp, Artificial Sequence
  Synthetic construct
cgttgcctgattaatgctaacgc

SEQ ID NO: 13250 - DNA, 23 bp, Artificial Sequence
  Synthetic construct
gttgcctgattaatgctaacgca

SEQ ID NO: 13251 - DNA, 23 bp, Artificial Sequence
  Synthetic construct
ttgcctgattaatgctaacgcat

SEQ ID NO: 13252 - DNA, 23 bp, Artificial Sequence
  Synthetic construct
tgcctgattaatgctaacgcatc

SEQ ID NO: 13253 - DNA, 23 bp, Artificial Sequence
  Synthetic construct
gcctgattaatgctaacgcatct

SEQ ID NO: 13254 - DNA, 23 bp, Artificial Sequence
  Synthetic construct
cctgattaatgctaacgcatcta

SEQ ID NO: 13255 - DNA, 23 bp, Artificial Sequence
  Synthetic construct
ctgattaatgctaacgcatctaa

SEQ ID NO: 13256 - DNA, 23 bp, Artificial Sequence
  Synthetic construct
tgattaatgctaacgcatctaag

SEQ ID NO: 13257 - DNA, 23 bp, Artificial Sequence
  Synthetic construct
gattaatgctaacgcatctaagg

SEQ ID NO: 13258 - DNA, 23 bp, Artificial Sequence
  Synthetic construct
attaatgctaacgcatctaaggt

SEQ ID NO: 13259 - DNA, 23 bp, Artificial Sequence
  Synthetic construct
ttaatgctaacgcatctaaggta

SEQ ID NO: 13260 - DNA, 23 bp, Artificial Sequence
  Synthetic construct
taatgctaacgcatctaaggtat

SEQ ID NO: 13261 - DNA, 23 bp, Artificial Sequence
  Synthetic construct
aatgctaacgcatctaaggtatg

SEQ ID NO: 13262 - DNA, 23 bp, Artificial Sequence
  Synthetic construct
atgctaacgcatctaaggtatgg

SEQ ID NO: 13263 - DNA, 23 bp, Artificial Sequence
  Synthetic construct
tgctaacgcatctaaggtatgga

SEQ ID NO: 13264 - DNA, 23 bp, Artificial Sequence
  Synthetic construct
gctaacgcatctaaggtatggac

SEQ ID NO: 13265 - DNA, 23 bp, Artificial Sequence
  Synthetic construct
ctaacgcatctaaggtatggacc

SEQ ID NO: 13266 - DNA, 23 bp, Artificial Sequence
  Synthetic construct
taacgcatctaaggtatggacca

SEQ ID NO: 13267 - DNA, 23 bp, Artificial Sequence
  Synthetic construct
aacgcatctaaggtatggaccat

SEQ ID NO: 13268 - DNA, 23 bp, Artificial Sequence
  Synthetic construct
acgcatctaaggtatggaccatc

SEQ ID NO: 13269 - DNA, 23 bp, Artificial Sequence
  Synthetic construct
cgcatctaaggtatggaccatcg

SEQ ID NO: 13270 - DNA, 23 bp, Artificial Sequence
  Synthetic construct
gcatctaaggtatggaccatcga

SEQ ID NO: 13271 - DNA, 23 bp, Artificial Sequence
  Synthetic construct
catctaaggtatggaccatcgag

SEQ ID NO: 13272 - DNA, 23 bp, Artificial Sequence
  Synthetic construct
atctaaggtatggaccatcgaga

SEQ ID NO: 13273 - DNA, 23 bp, Artificial Sequence
  Synthetic construct
tctaaggtatggaccatcgagaa

SEQ ID NO: 13274 - DNA, 23 bp, Artificial Sequence
  Synthetic construct
ctaaggtatggaccatcgagaaa

SEQ ID NO: 13275 - DNA, 23 bp, Artificial Sequence
  Synthetic construct
taaggtatggaccatcgagaaag

SEQ ID NO: 13276 - DNA, 23 bp, Artificial Sequence
  Synthetic construct
aaggtatggaccatcgagaaagg

SEQ ID NO: 13277 - DNA, 23 bp, Artificial Sequence
  Synthetic construct
aggtatggaccatcgagaaagga

SEQ ID NO: 13278 - DNA, 23 bp, Artificial Sequence
  Synthetic construct
ggtatggaccatcgagaaaggag

SEQ ID NO: 13279 - DNA, 23 bp, Artificial Sequence
  Synthetic construct
gtatggaccatcgagaaaggaga

SEQ ID NO: 13280 - DNA, 23 bp, Artificial Sequence
  Synthetic construct
tatggaccatcgagaaaggagac

SEQ ID NO: 13281 - DNA, 23 bp, Artificial Sequence
  Synthetic construct
atggaccatcgagaaaggagact

SEQ ID NO: 13282 - DNA, 23 bp, Artificial Sequence
  Synthetic construct
tggaccatcgagaaaggagactt

SEQ ID NO: 13283 - DNA, 23 bp, Artificial Sequence
  Synthetic construct
ggaccatcgagaaaggagacttt

SEQ ID NO: 13284 - DNA, 23 bp, Artificial Sequence
  Synthetic construct
gaccatcgagaaaggagacttta

SEQ ID NO: 13285 - DNA, 23 bp, Artificial Sequence
  Synthetic construct
accatcgagaaaggagactttac

SEQ ID NO: 13286 - DNA, 23 bp, Artificial Sequence
  Synthetic construct
ccatcgagaaaggagactttacg

SEQ ID NO: 13287 - DNA, 23 bp, Artificial Sequence
  Synthetic construct
catcgagaaaggagactttacgt

SEQ ID NO: 13288 - DNA, 23 bp, Artificial Sequence
  Synthetic construct
atcgagaaaggagactttacgta

SEQ ID NO: 13289 - DNA, 23 bp, Artificial Sequence
  Synthetic construct
tcgagaaaggagactttacgtac

SEQ ID NO: 13290 - DNA, 23 bp, Artificial Sequence
  Synthetic construct
cgagaaaggagactttacgtacg

SEQ ID NO: 13291 - DNA, 23 bp, Artificial Sequence
  Synthetic construct
gagaaaggagactttacgtacgc

SEQ ID NO: 13292 - DNA, 23 bp, Artificial Sequence
  Synthetic construct
agaaaggagactttacgtacgcg

SEQ ID NO: 13293 - DNA, 23 bp, Artificial Sequence
  Synthetic construct
gaaaggagactttacgtacgcgc

SEQ ID NO: 13294 - DNA, 23 bp, Artificial Sequence
  Synthetic construct
aaaggagactttacgtacgcgcc

SEQ ID NO: 13295 - DNA, 23 bp, Artificial Sequence
  Synthetic construct
aaggagactttacgtacgcgcca

SEQ ID NO: 13296 - DNA, 23 bp, Artificial Sequence
  Synthetic construct
aggagactttacgtacgcgccag

SEQ ID NO: 13297 - DNA, 23 bp, Artificial Sequence
  Synthetic construct
ggagactttacgtacgcgccagt

SEQ ID NO: 13298 - DNA, 23 bp, Artificial Sequence
  Synthetic construct
gagactttacgtacgcgccagtt

SEQ ID NO: 13299 - DNA, 23 bp, Artificial Sequence
  Synthetic construct
agactttacgtacgcgccagttg

SEQ ID NO: 13300 - DNA, 23 bp, Artificial Sequence
  Synthetic construct
gactttacgtacgcgccagttgt

SEQ ID NO: 13301 - DNA, 23 bp, Artificial Sequence
  Synthetic construct
actttacgtacgcgccagttgtt

SEQ ID NO: 13302 - DNA, 23 bp, Artificial Sequence
  Synthetic construct
ctttacgtacgcgccagttgttg

SEQ ID NO: 13303 - DNA, 23 bp, Artificial Sequence
  Synthetic construct
tttacgtacgcgccagttgttgg

SEQ ID NO: 13304 - DNA, 23 bp, Artificial Sequence
  Synthetic construct
ttacgtacgcgccagttgttggc

SEQ ID NO: 13305 - DNA, 23 bp, Artificial Sequence
  Synthetic construct
tacgtacgcgccagttgttggcc

SEQ ID NO: 13306 - DNA, 23 bp, Artificial Sequence
  Synthetic construct
acgtacgcgccagttgttggcca

SEQ ID NO: 13307 - DNA, 23 bp, Artificial Sequence
  Synthetic construct
cgtacgcgccagttgttggccat

SEQ ID NO: 13308 - DNA, 23 bp, Artificial Sequence
  Synthetic construct
gtacgcgccagttgttggccata

SEQ ID NO: 13309 - DNA, 23 bp, Artificial Sequence
  Synthetic construct
tacgcgccagttgttggccatac

SEQ ID NO: 13310 - DNA, 23 bp, Artificial Sequence
  Synthetic construct
acgcgccagttgttggccatacg

SEQ ID NO: 13311 - DNA, 23 bp, Artificial Sequence
  Synthetic construct
cgcgccagttgttggccatacgg

SEQ ID NO: 13312 - DNA, 23 bp, Artificial Sequence
  Synthetic construct
gcgccagttgttggccatacgga

SEQ ID NO: 13313 - DNA, 23 bp, Artificial Sequence
  Synthetic construct
cgccagttgttggccatacggat

SEQ ID NO: 13314 - DNA, 23 bp, Artificial Sequence
  Synthetic construct
gccagttgttggccatacggatt

SEQ ID NO: 13315 - DNA, 23 bp, Artificial Sequence
  Synthetic construct
ccagttgttggccatacggattg

SEQ ID NO: 13316 - DNA, 23 bp, Artificial Sequence
  Synthetic construct
cagttgttggccatacggattgt

SEQ ID NO: 13317 - DNA, 23 bp, Artificial Sequence
  Synthetic construct
agttgttggccatacggattgta

SEQ ID NO: 13318 - DNA, 23 bp, Artificial Sequence
  Synthetic construct
gttgttggccatacggattgtac

SEQ ID NO: 13319 - DNA, 23 bp, Artificial Sequence
  Synthetic construct
ttgttggccatacggattgtacc

SEQ ID NO: 13320 - DNA, 23 bp, Artificial Sequence
  Synthetic construct
tgttggccatacggattgtaccc

SEQ ID NO: 13321 - DNA, 23 bp, Artificial Sequence
  Synthetic construct
gttggccatacggattgtacccc

SEQ ID NO: 13322 - DNA, 23 bp, Artificial Sequence
  Synthetic construct
ttggccatacggattgtacccct

SEQ ID NO: 13323 - DNA, 23 bp, Artificial Sequence
  Synthetic construct
tggccatacggattgtacccctc

SEQ ID NO: 13324 - DNA, 23 bp, Artificial Sequence
  Synthetic construct
ggccatacggattgtacccctcg

SEQ ID NO: 13325 - DNA, 23 bp, Artificial Sequence
  Synthetic construct
gccatacggattgtacccctcga

SEQ ID NO: 13326 - DNA, 23 bp, Artificial Sequence
  Synthetic construct
ccatacggattgtacccctcgat

SEQ ID NO: 13327 - DNA, 23 bp, Artificial Sequence
  Synthetic construct
catacggattgtacccctcgatg

SEQ ID NO: 13328 - DNA, 23 bp, Artificial Sequence
  Synthetic construct
atacggattgtacccctcgatgc

SEQ ID NO: 13329 - DNA, 23 bp, Artificial Sequence
  Synthetic construct
tacggattgtacccctcgatgca

SEQ ID NO: 13330 - DNA, 23 bp, Artificial Sequence
  Synthetic construct
acggattgtacccctcgatgcat

SEQ ID NO: 13331 - DNA, 23 bp, Artificial Sequence
  Synthetic construct
cggattgtacccctcgatgcatg

SEQ ID NO: 13332 - DNA, 23 bp, Artificial Sequence
  Synthetic construct
ggattgtacccctcgatgcatgg

SEQ ID NO: 13333 - DNA, 23 bp, Artificial Sequence
  Synthetic construct
gattgtacccctcgatgcatggc

SEQ ID NO: 13334 - DNA, 23 bp, Artificial Sequence
  Synthetic construct
attgtacccctcgatgcatggct

SEQ ID NO: 13335 - DNA, 23 bp, Artificial Sequence
  Synthetic construct
ttgtacccctcgatgcatggctg

SEQ ID NO: 13336 - DNA, 23 bp, Artificial Sequence
  Synthetic construct
tgtacccctcgatgcatggctga

SEQ ID NO: 13337 - DNA, 23 bp, Artificial Sequence
  Synthetic construct
gtacccctcgatgcatggctgag

SEQ ID NO: 13338 - DNA, 23 bp, Artificial Sequence
  Synthetic construct
tacccctcgatgcatggctgaga

SEQ ID NO: 13339 - DNA, 23 bp, Artificial Sequence
  Synthetic construct
acccctcgatgcatggctgagat

SEQ ID NO: 13340 - DNA, 23 bp, Artificial Sequence
  Synthetic construct
cccctcgatgcatggctgagatt

SEQ ID NO: 13341 - DNA, 23 bp, Artificial Sequence
  Synthetic construct
ccctcgatgcatggctgagattt

SEQ ID NO: 13342 - DNA, 23 bp, Artificial Sequence
  Synthetic construct
cctcgatgcatggctgagatttg

SEQ ID NO: 13343 - DNA, 23 bp, Artificial Sequence
  Synthetic construct
ctcgatgcatggctgagatttgg

SEQ ID NO: 13344 - DNA, 23 bp, Artificial Sequence
  Synthetic construct
tcgatgcatggctgagatttggg

SEQ ID NO: 13345 - DNA, 23 bp, Artificial Sequence
  Synthetic construct
cgatgcatggctgagatttgggc

SEQ ID NO: 13346 - DNA, 23 bp, Artificial Sequence
  Synthetic construct
gatgcatggctgagatttgggcc

SEQ ID NO: 13347 - DNA, 23 bp, Artificial Sequence
  Synthetic construct
atgcatggctgagatttgggcct

SEQ ID NO: 13348 - DNA, 23 bp, Artificial Sequence
  Synthetic construct
tgcatggctgagatttgggcctt

SEQ ID NO: 13349 - DNA, 23 bp, Artificial Sequence
  Synthetic construct
gcatggctgagatttgggcctta

SEQ ID NO: 13350 - DNA, 23 bp, Artificial Sequence
  Synthetic construct
catggctgagatttgggccttag

SEQ ID NO: 13351 - DNA, 23 bp, Artificial Sequence
  Synthetic construct
atggctgagatttgggccttagc

SEQ ID NO: 13352 - DNA, 23 bp, Artificial Sequence
  Synthetic construct
tggctgagatttgggccttagca

SEQ ID NO: 13353 - DNA, 23 bp, Artificial Sequence
  Synthetic construct
ggctgagatttgggccttagcag

SEQ ID NO: 13354 - DNA, 23 bp, Artificial Sequence
  Synthetic construct
gctgagatttgggccttagcagt

SEQ ID NO: 13355 - DNA, 23 bp, Artificial Sequence
  Synthetic construct
ctgagatttgggccttagcagtg

SEQ ID NO: 13356 - DNA, 23 bp, Artificial Sequence
  Synthetic construct
tgagatttgggccttagcagtgc

SEQ ID NO: 13357 - DNA, 23 bp, Artificial Sequence
  Synthetic construct
gagatttgggccttagcagtgcc

SEQ ID NO: 13358 - DNA, 23 bp, Artificial Sequence
  Synthetic construct
agatttgggccttagcagtgccc

SEQ ID NO: 13359 - DNA, 23 bp, Artificial Sequence
  Synthetic construct
gatttgggccttagcagtgccct

SEQ ID NO: 13360 - DNA, 23 bp, Artificial Sequence
  Synthetic construct
atttgggccttagcagtgccctg

SEQ ID NO: 13361 - DNA, 23 bp, Artificial Sequence
  Synthetic construct
tttgggccttagcagtgccctgt

SEQ ID NO: 13362 - DNA, 23 bp, Artificial Sequence
  Synthetic construct
ttgggccttagcagtgccctgtc

SEQ ID NO: 13363 - DNA, 23 bp, Artificial Sequence
  Synthetic construct
tgggccttagcagtgccctgtct

SEQ ID NO: 13364 - DNA, 23 bp, Artificial Sequence
  Synthetic construct
gggccttagcagtgccctgtctc

SEQ ID NO: 13365 - DNA, 23 bp, Artificial Sequence
  Synthetic construct
ggccttagcagtgccctgtctct

SEQ ID NO: 13366 - DNA, 23 bp, Artificial Sequence
  Synthetic construct
gccttagcagtgccctgtctctc

SEQ ID NO: 13367 - DNA, 23 bp, Artificial Sequence
  Synthetic construct
ccttagcagtgccctgtctctcc

SEQ ID NO: 13368 - DNA, 23 bp, Artificial Sequence
  Synthetic construct
cttagcagtgccctgtctctcca

SEQ ID NO: 13369 - DNA, 23 bp, Artificial Sequence
  Synthetic construct
ttagcagtgccctgtctctccac

SEQ ID NO: 13370 - DNA, 23 bp, Artificial Sequence
  Synthetic construct
tagcagtgccctgtctctccaca

SEQ ID NO: 13371 - DNA, 23 bp, Artificial Sequence
  Synthetic construct
agcagtgccctgtctctccacag

SEQ ID NO: 13372 - DNA, 23 bp, Artificial Sequence
  Synthetic construct
gcagtgccctgtctctccacagt

SEQ ID NO: 13373 - DNA, 23 bp, Artificial Sequence
  Synthetic construct
cagtgccctgtctctccacagtc

SEQ ID NO: 13374 - DNA, 23 bp, Artificial Sequence
  Synthetic construct
agtgccctgtctctccacagtcc

SEQ ID NO: 13375 - DNA, 23 bp, Artificial Sequence
  Synthetic construct
gtgccctgtctctccacagtcca

SEQ ID NO: 13376 - DNA, 23 bp, Artificial Sequence
  Synthetic construct
tgccctgtctctccacagtccac

SEQ ID NO: 13377 - DNA, 23 bp, Artificial Sequence
  Synthetic construct
gccctgtctctccacagtccacc

SEQ ID NO: 13378 - DNA, 23 bp, Artificial Sequence
  Synthetic construct
ccctgtctctccacagtccaccc

SEQ ID NO: 13379 - DNA, 23 bp, Artificial Sequence
  Synthetic construct
cctgtctctccacagtccacccg

SEQ ID NO: 13380 - DNA, 23 bp, Artificial Sequence
  Synthetic construct
ctgtctctccacagtccacccgt

SEQ ID NO: 13381 - DNA, 23 bp, Artificial Sequence
  Synthetic construct
tgtctctccacagtccacccgta

SEQ ID NO: 13382 - DNA, 23 bp, Artificial Sequence
  Synthetic construct
gtctctccacagtccacccgtag

SEQ ID NO: 13383 - DNA, 23 bp, Artificial Sequence
  Synthetic construct
tctctccacagtccacccgtagg

SEQ ID NO: 13384 - DNA, 23 bp, Artificial Sequence
  Synthetic construct
ctctccacagtccacccgtaggg

SEQ ID NO: 13385 - DNA, 23 bp, Artificial Sequence
  Synthetic construct
tctccacagtccacccgtaggga

SEQ ID NO: 13386 - DNA, 23 bp, Artificial Sequence
  Synthetic construct
ctccacagtccacccgtagggag

SEQ ID NO: 13387 - DNA, 23 bp, Artificial Sequence
  Synthetic construct
tccacagtccacccgtagggagc

SEQ ID NO: 13388 - DNA, 23 bp, Artificial Sequence
  Synthetic construct
ccacagtccacccgtagggagcg

SEQ ID NO: 13389 - DNA, 23 bp, Artificial Sequence
  Synthetic construct
cacagtccacccgtagggagcgt

SEQ ID NO: 13390 - DNA, 23 bp, Artificial Sequence
  Synthetic construct
acagtccacccgtagggagcgtc

SEQ ID NO: 13391 - DNA, 23 bp, Artificial Sequence
  Synthetic construct
cagtccacccgtagggagcgtca

SEQ ID NO: 13392 - DNA, 23 bp, Artificial Sequence
  Synthetic construct
agtccacccgtagggagcgtcaa

SEQ ID NO: 13393 - DNA, 23 bp, Artificial Sequence
  Synthetic construct
gtccacccgtagggagcgtcaac

SEQ ID NO: 13394 - DNA, 23 bp, Artificial Sequence
  Synthetic construct
tccacccgtagggagcgtcaacg

SEQ ID NO: 13395 - DNA, 23 bp, Artificial Sequence
  Synthetic construct
ccacccgtagggagcgtcaacgc

SEQ ID NO: 13396 - DNA, 23 bp, Artificial Sequence
  Synthetic construct
cacccgtagggagcgtcaacgct

SEQ ID NO: 13397 - DNA, 23 bp, Artificial Sequence
  Synthetic construct
acccgtagggagcgtcaacgctt

SEQ ID NO: 13398 - DNA, 23 bp, Artificial Sequence
  Synthetic construct
cccgtagggagcgtcaacgctta

SEQ ID NO: 13399 - DNA, 23 bp, Artificial Sequence
  Synthetic construct
ccgtagggagcgtcaacgcttat

SEQ ID NO: 13400 - DNA, 23 bp, Artificial Sequence
  Synthetic construct
cgtagggagcgtcaacgcttatg

SEQ ID NO: 13401 - DNA, 23 bp, Artificial Sequence
  Synthetic construct
gtagggagcgtcaacgcttatga

SEQ ID NO: 13402 - DNA, 23 bp, Artificial Sequence
  Synthetic construct
tagggagcgtcaacgcttatgat

SEQ ID NO: 13403 - DNA, 23 bp, Artificial Sequence
  Synthetic construct
agggagcgtcaacgcttatgatg

SEQ ID NO: 13404 - DNA, 23 bp, Artificial Sequence
  Synthetic construct
gggagcgtcaacgcttatgatgg

SEQ ID NO: 13405 - DNA, 23 bp, Artificial Sequence
  Synthetic construct
ggagcgtcaacgcttatgatgga

SEQ ID NO: 13406 - DNA, 23 bp, Artificial Sequence
  Synthetic construct
gagcgtcaacgcttatgatggac

SEQ ID NO: 13407 - DNA, 23 bp, Artificial Sequence
  Synthetic construct
agcgtcaacgcttatgatggact

SEQ ID NO: 13408 - DNA, 23 bp, Artificial Sequence
  Synthetic construct
gcgtcaacgcttatgatggactc

SEQ ID NO: 13409 - DNA, 23 bp, Artificial Sequence
  Synthetic construct
cgtcaacgcttatgatggactca

SEQ ID NO: 13410 - DNA, 23 bp, Artificial Sequence
  Synthetic construct
gtcaacgcttatgatggactcac

SEQ ID NO: 13411 - DNA, 23 bp, Artificial Sequence
  Synthetic construct
tcaacgcttatgatggactcacc

SEQ ID NO: 13412 - DNA, 23 bp, Artificial Sequence
  Synthetic construct
caacgcttatgatggactcaccc

SEQ ID NO: 13413 - DNA, 23 bp, Artificial Sequence
  Synthetic construct
aacgcttatgatggactcacccg

SEQ ID NO: 13414 - DNA, 23 bp, Artificial Sequence
  Synthetic construct
acgcttatgatggactcacccgt

SEQ ID NO: 13415 - DNA, 23 bp, Artificial Sequence
  Synthetic construct
cgcttatgatggactcacccgtt

SEQ ID NO: 13416 - DNA, 23 bp, Artificial Sequence
  Synthetic construct
gcttatgatggactcacccgtta

SEQ ID NO: 13417 - DNA, 23 bp, Artificial Sequence
  Synthetic construct
cttatgatggactcacccgttat

SEQ ID NO: 13418 - DNA, 23 bp, Artificial Sequence
  Synthetic construct
ttatgatggactcacccgttatt

SEQ ID NO: 13419 - DNA, 23 bp, Artificial Sequence
  Synthetic construct
tatgatggactcacccgttatta

SEQ ID NO: 13420 - DNA, 23 bp, Artificial Sequence
  Synthetic construct
atgatggactcacccgttattac

SEQ ID NO: 13421 - DNA, 23 bp, Artificial Sequence
  Synthetic construct
tgatggactcacccgttattacg

SEQ ID NO: 13422 - DNA, 23 bp, Artificial Sequence
  Synthetic construct
gatggactcacccgttattacgt

SEQ ID NO: 13423 - DNA, 23 bp, Artificial Sequence
  Synthetic construct
atggactcacccgttattacgtc

SEQ ID NO: 13424 - DNA, 23 bp, Artificial Sequence
  Synthetic construct
tggactcacccgttattacgtca

SEQ ID NO: 13425 - DNA, 23 bp, Artificial Sequence
  Synthetic construct
ggactcacccgttattacgtcag

SEQ ID NO: 13426 - DNA, 23 bp, Artificial Sequence
  Synthetic construct
gactcacccgttattacgtcagt

SEQ ID NO: 13427 - DNA, 23 bp, Artificial Sequence
  Synthetic construct
actcacccgttattacgtcagta

SEQ ID NO: 13428 - DNA, 23 bp, Artificial Sequence
  Synthetic construct
ctcacccgttattacgtcagtaa

SEQ ID NO: 13429 - DNA, 23 bp, Artificial Sequence
  Synthetic construct
tcacccgttattacgtcagtaac

SEQ ID NO: 13430 - DNA, 23 bp, Artificial Sequence
  Synthetic construct
cacccgttattacgtcagtaact

SEQ ID NO: 13431 - DNA, 23 bp, Artificial Sequence
  Synthetic construct
acccgttattacgtcagtaactg

SEQ ID NO: 13432 - DNA, 23 bp, Artificial Sequence
  Synthetic construct
cccgttattacgtcagtaactgt

SEQ ID NO: 13433 - DNA, 23 bp, Artificial Sequence
  Synthetic construct
ccgttattacgtcagtaactgtt

SEQ ID NO: 13434 - DNA, 23 bp, Artificial Sequence
  Synthetic construct
cgttattacgtcagtaactgttc

SEQ ID NO: 13435 - DNA, 23 bp, Artificial Sequence
  Synthetic construct
gttattacgtcagtaactgttcc

SEQ ID NO: 13436 - DNA, 23 bp, Artificial Sequence
  Synthetic construct
ttattacgtcagtaactgttcct

SEQ ID NO: 13437 - DNA, 23 bp, Artificial Sequence
  Synthetic construct
tattacgtcagtaactgttcctg

SEQ ID NO: 13438 - DNA, 23 bp, Artificial Sequence
  Synthetic construct
attacgtcagtaactgttcctga

SEQ ID NO: 13439 - DNA, 23 bp, Artificial Sequence
  Synthetic construct
ttacgtcagtaactgttcctgac

SEQ ID NO: 13440 - DNA, 23 bp, Artificial Sequence
  Synthetic construct
tacgtcagtaactgttcctgaca

SEQ ID NO: 13441 - DNA, 23 bp, Artificial Sequence
  Synthetic construct
acgtcagtaactgttcctgacat

SEQ ID NO: 13442 - DNA, 23 bp, Artificial Sequence
  Synthetic construct
cgtcagtaactgttcctgacatg

SEQ ID NO: 13443 - DNA, 23 bp, Artificial Sequence
  Synthetic construct
gtcagtaactgttcctgacatgt

SEQ ID NO: 13444 - DNA, 23 bp, Artificial Sequence
  Synthetic construct
tcagtaactgttcctgacatgta

SEQ ID NO: 13445 - DNA, 23 bp, Artificial Sequence
  Synthetic construct
cagtaactgttcctgacatgtag

SEQ ID NO: 13446 - DNA, 23 bp, Artificial Sequence
  Synthetic construct
agtaactgttcctgacatgtagg

SEQ ID NO: 13447 - DNA, 23 bp, Artificial Sequence
  Synthetic construct
gtaactgttcctgacatgtagga

SEQ ID NO: 13448 - DNA, 23 bp, Artificial Sequence
  Synthetic construct
taactgttcctgacatgtaggag

SEQ ID NO: 13449 - DNA, 23 bp, Artificial Sequence
  Synthetic construct
aactgttcctgacatgtaggagc

SEQ ID NO: 13450 - DNA, 23 bp, Artificial Sequence
  Synthetic construct
actgttcctgacatgtaggagca

SEQ ID NO: 13451 - DNA, 23 bp, Artificial Sequence
  Synthetic construct
ctgttcctgacatgtaggagcat

SEQ ID NO: 13452 - DNA, 23 bp, Artificial Sequence
  Synthetic construct
tgttcctgacatgtaggagcatc

SEQ ID NO: 13453 - DNA, 23 bp, Artificial Sequence
  Synthetic construct
gttcctgacatgtaggagcatcc

SEQ ID NO: 13454 - DNA, 23 bp, Artificial Sequence
  Synthetic construct
ttcctgacatgtaggagcatccc

SEQ ID NO: 13455 - DNA, 23 bp, Artificial Sequence
  Synthetic construct
tcctgacatgtaggagcatccca

SEQ ID NO: 13456 - DNA, 23 bp, Artificial Sequence
  Synthetic construct
cctgacatgtaggagcatcccac

SEQ ID NO: 13457 - DNA, 23 bp, Artificial Sequence
  Synthetic construct
ctgacatgtaggagcatcccacg

SEQ ID NO: 13458 - DNA, 23 bp, Artificial Sequence
  Synthetic construct
tgacatgtaggagcatcccacgg

SEQ ID NO: 13459 - DNA, 23 bp, Artificial Sequence
  Synthetic construct
gacatgtaggagcatcccacggg

SEQ ID NO: 13460 - DNA, 23 bp, Artificial Sequence
  Synthetic construct
acatgtaggagcatcccacgggg

SEQ ID NO: 13461 - DNA, 23 bp, Artificial Sequence
  Synthetic construct
catgtaggagcatcccacggggg

SEQ ID NO: 13462 - DNA, 23 bp, Artificial Sequence
  Synthetic construct
atgtaggagcatcccacgggggc

SEQ ID NO: 13463 - DNA, 23 bp, Artificial Sequence
  Synthetic construct
tgtaggagcatcccacgggggcc

SEQ ID NO: 13464 - DNA, 23 bp, Artificial Sequence
  Synthetic construct
gtaggagcatcccacgggggccg

SEQ ID NO: 13465 - DNA, 23 bp, Artificial Sequence
  Synthetic construct
taggagcatcccacgggggccgt

SEQ ID NO: 13466 - DNA, 23 bp, Artificial Sequence
  Synthetic construct
aggagcatcccacgggggccgta

SEQ ID NO: 13467 - DNA, 23 bp, Artificial Sequence
  Synthetic construct
ggagcatcccacgggggccgtaa

SEQ ID NO: 13468 - DNA, 23 bp, Artificial Sequence
  Synthetic construct
gagcatcccacgggggccgtaag

SEQ ID NO: 13469 - DNA, 23 bp, Artificial Sequence
  Synthetic construct
agcatcccacgggggccgtaagg

SEQ ID NO: 13470 - DNA, 23 bp, Artificial Sequence
  Synthetic construct
gcatcccacgggggccgtaaggc

SEQ ID NO: 13471 - DNA, 23 bp, Artificial Sequence
  Synthetic construct
catcccacgggggccgtaaggcc

SEQ ID NO: 13472 - DNA, 23 bp, Artificial Sequence
  Synthetic construct
atcccacgggggccgtaaggccc

SEQ ID NO: 13473 - DNA, 23 bp, Artificial Sequence
  Synthetic construct
tcccacgggggccgtaaggccct

SEQ ID NO: 13474 - DNA, 23 bp, Artificial Sequence
  Synthetic construct
cccacgggggccgtaaggccctc

SEQ ID NO: 13475 - DNA, 23 bp, Artificial Sequence
  Synthetic construct
ccacgggggccgtaaggccctcg

SEQ ID NO: 13476 - DNA, 23 bp, Artificial Sequence
  Synthetic construct
cacgggggccgtaaggccctcga

SEQ ID NO: 13477 - DNA, 23 bp, Artificial Sequence
  Synthetic construct
acgggggccgtaaggccctcgag

SEQ ID NO: 13478 - DNA, 23 bp, Artificial Sequence
  Synthetic construct
cgggggccgtaaggccctcgagc

SEQ ID NO: 13479 - DNA, 23 bp, Artificial Sequence
  Synthetic construct
gggggccgtaaggccctcgagca

SEQ ID NO: 13480 - DNA, 23 bp, Artificial Sequence
  Synthetic construct
ggggccgtaaggccctcgagcat

SEQ ID NO: 13481 - DNA, 23 bp, Artificial Sequence
  Synthetic construct
gggccgtaaggccctcgagcatg

SEQ ID NO: 13482 - DNA, 23 bp, Artificial Sequence
  Synthetic construct
ggccgtaaggccctcgagcatgt

SEQ ID NO: 13483 - DNA, 23 bp, Artificial Sequence
  Synthetic construct
gccgtaaggccctcgagcatgtt

SEQ ID NO: 13484 - DNA, 23 bp, Artificial Sequence
  Synthetic construct
ccgtaaggccctcgagcatgtta

SEQ ID NO: 13485 - DNA, 23 bp, Artificial Sequence
  Synthetic construct
cgtaaggccctcgagcatgttac

SEQ ID NO: 13486 - DNA, 23 bp, Artificial Sequence
  Synthetic construct
gtaaggccctcgagcatgttacc

SEQ ID NO: 13487 - DNA, 23 bp, Artificial Sequence
  Synthetic construct
taaggccctcgagcatgttacct

SEQ ID NO: 13488 - DNA, 23 bp, Artificial Sequence
  Synthetic construct
aaggccctcgagcatgttaccta

SEQ ID NO: 13489 - DNA, 23 bp, Artificial Sequence
  Synthetic construct
aggccctcgagcatgttacctac

SEQ ID NO: 13490 - DNA, 23 bp, Artificial Sequence
  Synthetic construct
ggccctcgagcatgttacctaca

SEQ ID NO: 13491 - DNA, 23 bp, Artificial Sequence
  Synthetic construct
gccctcgagcatgttacctacag

SEQ ID NO: 13492 - DNA, 23 bp, Artificial Sequence
  Synthetic construct
ccctcgagcatgttacctacagg

SEQ ID NO: 13493 - DNA, 23 bp, Artificial Sequence
  Synthetic construct
cctcgagcatgttacctacaggt

SEQ ID NO: 13494 - DNA, 23 bp, Artificial Sequence
  Synthetic construct
ctcgagcatgttacctacaggta

SEQ ID NO: 13495 - DNA, 23 bp, Artificial Sequence
  Synthetic construct
tcgagcatgttacctacaggtag

SEQ ID NO: 13496 - DNA, 23 bp, Artificial Sequence
  Synthetic construct
cgagcatgttacctacaggtagg

SEQ ID NO: 13497 - DNA, 23 bp, Artificial Sequence
  Synthetic construct
gagcatgttacctacaggtagga

SEQ ID NO: 13498 - DNA, 23 bp, Artificial Sequence
  Synthetic construct
agcatgttacctacaggtaggag

SEQ ID NO: 13499 - DNA, 23 bp, Artificial Sequence
  Synthetic construct
gcatgttacctacaggtaggagc

SEQ ID NO: 13500 - DNA, 23 bp, Artificial Sequence
  Synthetic construct
catgttacctacaggtaggagcc

SEQ ID NO: 13501 - DNA, 23 bp, Artificial Sequence
  Synthetic construct
atgttacctacaggtaggagcca

SEQ ID NO: 13502 - DNA, 23 bp, Artificial Sequence
  Synthetic construct
tgttacctacaggtaggagccag

SEQ ID NO: 13503 - DNA, 23 bp, Artificial Sequence
  Synthetic construct
gttacctacaggtaggagccagt

SEQ ID NO: 13504 - DNA, 23 bp, Artificial Sequence
  Synthetic construct
ttacctacaggtaggagccagtc

SEQ ID NO: 13505 - DNA, 23 bp, Artificial Sequence
  Synthetic construct
tacctacaggtaggagccagtcg

SEQ ID NO: 13506 - DNA, 23 bp, Artificial Sequence
  Synthetic construct
acctacaggtaggagccagtcga

SEQ ID NO: 13507 - DNA, 23 bp, Artificial Sequence
  Synthetic construct
cctacaggtaggagccagtcgac

SEQ ID NO: 13508 - DNA, 23 bp, Artificial Sequence
  Synthetic construct
ctacaggtaggagccagtcgaca

SEQ ID NO: 13509 - DNA, 23 bp, Artificial Sequence
  Synthetic construct
tacaggtaggagccagtcgacaa

SEQ ID NO: 13510 - DNA, 23 bp, Artificial Sequence
  Synthetic construct
acaggtaggagccagtcgacaac

SEQ ID NO: 13511 - DNA, 23 bp, Artificial Sequence
  Synthetic construct
caggtaggagccagtcgacaacg

SEQ ID NO: 13512 - DNA, 23 bp, Artificial Sequence
  Synthetic construct
aggtaggagccagtcgacaacga

SEQ ID NO: 13513 - DNA, 23 bp, Artificial Sequence
  Synthetic construct
ggtaggagccagtcgacaacgaa

SEQ ID NO: 13514 - DNA, 23 bp, Artificial Sequence
  Synthetic construct
gtaggagccagtcgacaacgaat

SEQ ID NO: 13515 - DNA, 23 bp, Artificial Sequence
  Synthetic construct
taggagccagtcgacaacgaatg

SEQ ID NO: 13516 - DNA, 23 bp, Artificial Sequence
  Synthetic construct
aggagccagtcgacaacgaatga

SEQ ID NO: 13517 - DNA, 23 bp, Artificial Sequence
  Synthetic construct
ggagccagtcgacaacgaatgag

SEQ ID NO: 13518 - DNA, 23 bp, Artificial Sequence
  Synthetic construct
gagccagtcgacaacgaatgaga

SEQ ID NO: 13519 - DNA, 23 bp, Artificial Sequence
  Synthetic construct
agccagtcgacaacgaatgagaa

SEQ ID NO: 13520 - DNA, 23 bp, Artificial Sequence
  Synthetic construct
gccagtcgacaacgaatgagaaa

SEQ ID NO: 13521 - DNA, 23 bp, Artificial Sequence
  Synthetic construct
ccagtcgacaacgaatgagaaag

SEQ ID NO: 13522 - DNA, 23 bp, Artificial Sequence
  Synthetic construct
cagtcgacaacgaatgagaaagg

SEQ ID NO: 13523 - DNA, 23 bp, Artificial Sequence
  Synthetic construct
agtcgacaacgaatgagaaaggc

SEQ ID NO: 13524 - DNA, 23 bp, Artificial Sequence
  Synthetic construct
gtcgacaacgaatgagaaaggca

SEQ ID NO: 13525 - DNA, 23 bp, Artificial Sequence
  Synthetic construct
tcgacaacgaatgagaaaggcac

SEQ ID NO: 13526 - DNA, 23 bp, Artificial Sequence
  Synthetic construct
cgacaacgaatgagaaaggcacc

SEQ ID NO: 13527 - DNA, 23 bp, Artificial Sequence
  Synthetic construct
gacaacgaatgagaaaggcacct

SEQ ID NO: 13528 - DNA, 23 bp, Artificial Sequence
  Synthetic construct
acaacgaatgagaaaggcacctt

SEQ ID NO: 13529 - DNA, 23 bp, Artificial Sequence
  Synthetic construct
caacgaatgagaaaggcaccttt

SEQ ID NO: 13530 - DNA, 23 bp, Artificial Sequence
  Synthetic construct
aacgaatgagaaaggcacctttt

SEQ ID NO: 13531 - DNA, 23 bp, Artificial Sequence
  Synthetic construct
acgaatgagaaaggcaccttttc

SEQ ID NO: 13532 - DNA, 23 bp, Artificial Sequence
  Synthetic construct
cgaatgagaaaggcaccttttcc

SEQ ID NO: 13533 - DNA, 23 bp, Artificial Sequence
  Synthetic construct
gaatgagaaaggcaccttttccc

SEQ ID NO: 13534 - DNA, 23 bp, Artificial Sequence
  Synthetic construct
aatgagaaaggcaccttttccca

SEQ ID NO: 13535 - DNA, 23 bp, Artificial Sequence
  Synthetic construct
atgagaaaggcaccttttcccac

SEQ ID NO: 13536 - DNA, 23 bp, Artificial Sequence
  Synthetic construct
tgagaaaggcaccttttcccaca

SEQ ID NO: 13537 - DNA, 23 bp, Artificial Sequence
  Synthetic construct
gagaaaggcaccttttcccacac

SEQ ID NO: 13538 - DNA, 23 bp, Artificial Sequence
  Synthetic construct
agaaaggcaccttttcccacact

SEQ ID NO: 13539 - DNA, 23 bp, Artificial Sequence
  Synthetic construct
gaaaggcaccttttcccacacta

SEQ ID NO: 13540 - DNA, 23 bp, Artificial Sequence
  Synthetic construct
aaaggcaccttttcccacactat

SEQ ID NO: 13541 - DNA, 23 bp, Artificial Sequence
  Synthetic construct
aaggcaccttttcccacactata

SEQ ID NO: 13542 - DNA, 23 bp, Artificial Sequence
  Synthetic construct
aggcaccttttcccacactatac

SEQ ID NO: 13543 - DNA, 23 bp, Artificial Sequence
  Synthetic construct
ggcaccttttcccacactatacc

SEQ ID NO: 13544 - DNA, 23 bp, Artificial Sequence
  Synthetic construct
gcaccttttcccacactatacct

SEQ ID NO: 13545 - DNA, 23 bp, Artificial Sequence
  Synthetic construct
caccttttcccacactataccta

SEQ ID NO: 13546 - DNA, 23 bp, Artificial Sequence
  Synthetic construct
accttttcccacactatacctag

SEQ ID NO: 13547 - DNA, 23 bp, Artificial Sequence
  Synthetic construct
ccttttcccacactatacctagt

SEQ ID NO: 13548 - DNA, 23 bp, Artificial Sequence
  Synthetic construct
cttttcccacactatacctagtg

SEQ ID NO: 13549 - DNA, 23 bp, Artificial Sequence
  Synthetic construct
ttttcccacactatacctagtgg

SEQ ID NO: 13550 - DNA, 23 bp, Artificial Sequence
  Synthetic construct
tttcccacactatacctagtggg

SEQ ID NO: 13551 - DNA, 23 bp, Artificial Sequence
  Synthetic construct
ttcccacactatacctagtgggt

SEQ ID NO: 13552 - DNA, 23 bp, Artificial Sequence
  Synthetic construct
tcccacactatacctagtgggtt

SEQ ID NO: 13553 - DNA, 23 bp, Artificial Sequence
  Synthetic construct
cccacactatacctagtgggttc

SEQ ID NO: 13554 - DNA, 23 bp, Artificial Sequence
  Synthetic construct
ccacactatacctagtgggttca

SEQ ID NO: 13555 - DNA, 23 bp, Artificial Sequence
  Synthetic construct
cacactatacctagtgggttcaa

SEQ ID NO: 13556 - DNA, 23 bp, Artificial Sequence
  Synthetic construct
acactatacctagtgggttcaag

SEQ ID NO: 13557 - DNA, 23 bp, Artificial Sequence
  Synthetic construct
cactatacctagtgggttcaaga

SEQ ID NO: 13558 - DNA, 23 bp, Artificial Sequence
  Synthetic construct
actatacctagtgggttcaagat

SEQ ID NO: 13559 - DNA, 23 bp, Artificial Sequence
  Synthetic construct
ctatacctagtgggttcaagata

SEQ ID NO: 13560 - DNA, 23 bp, Artificial Sequence
  Synthetic construct
tatacctagtgggttcaagatac

SEQ ID NO: 13561 - DNA, 23 bp, Artificial Sequence
  Synthetic construct
atacctagtgggttcaagatacc

SEQ ID NO: 13562 - DNA, 23 bp, Artificial Sequence
  Synthetic construct
tacctagtgggttcaagatacct

SEQ ID NO: 13563 - DNA, 23 bp, Artificial Sequence
  Synthetic construct
acctagtgggttcaagataccta

SEQ ID NO: 13564 - DNA, 23 bp, Artificial Sequence
  Synthetic construct
cctagtgggttcaagatacctag

SEQ ID NO: 13565 - DNA, 23 bp, Artificial Sequence
  Synthetic construct
ctagtgggttcaagatacctaga

SEQ ID NO: 13566 - DNA, 23 bp, Artificial Sequence
  Synthetic construct
tagtgggttcaagatacctagag

SEQ ID NO: 13567 - DNA, 23 bp, Artificial Sequence
  Synthetic construct
agtgggttcaagatacctagaga

SEQ ID NO: 13568 - DNA, 23 bp, Artificial Sequence
  Synthetic construct
gtgggttcaagatacctagagac

SEQ ID NO: 13569 - DNA, 23 bp, Artificial Sequence
  Synthetic construct
tgggttcaagatacctagagacg

SEQ ID NO: 13570 - DNA, 23 bp, Artificial Sequence
  Synthetic construct
gggttcaagatacctagagacga

SEQ ID NO: 13571 - DNA, 23 bp, Artificial Sequence
  Synthetic construct
ggttcaagatacctagagacgac

SEQ ID NO: 13572 - DNA, 23 bp, Artificial Sequence
  Synthetic construct
gttcaagatacctagagacgaca

SEQ ID NO: 13573 - DNA, 23 bp, Artificial Sequence
  Synthetic construct
ttcaagatacctagagacgacaa

SEQ ID NO: 13574 - DNA, 23 bp, Artificial Sequence
  Synthetic construct
tcaagatacctagagacgacaac

SEQ ID NO: 13575 - DNA, 23 bp, Artificial Sequence
  Synthetic construct
caagatacctagagacgacaacc

SEQ ID NO: 13576 - DNA, 23 bp, Artificial Sequence
  Synthetic construct
aagatacctagagacgacaacca

SEQ ID NO: 13577 - DNA, 23 bp, Artificial Sequence
  Synthetic construct
agatacctagagacgacaaccat

SEQ ID NO: 13578 - DNA, 23 bp, Artificial Sequence
  Synthetic construct
gatacctagagacgacaaccatg

SEQ ID NO: 13579 - DNA, 23 bp, Artificial Sequence
  Synthetic construct
atacctagagacgacaaccatgc

SEQ ID NO: 13580 - DNA, 23 bp, Artificial Sequence
  Synthetic construct
tacctagagacgacaaccatgcc

SEQ ID NO: 13581 - DNA, 23 bp, Artificial Sequence
  Synthetic construct
acctagagacgacaaccatgcca

SEQ ID NO: 13582 - DNA, 23 bp, Artificial Sequence
  Synthetic construct
cctagagacgacaaccatgccaa

SEQ ID NO: 13583 - DNA, 23 bp, Artificial Sequence
  Synthetic construct
ctagagacgacaaccatgccaaa

SEQ ID NO: 13584 - DNA, 23 bp, Artificial Sequence
  Synthetic construct
tagagacgacaaccatgccaaac

SEQ ID NO: 13585 - DNA, 23 bp, Artificial Sequence
  Synthetic construct
agagacgacaaccatgccaaacg

SEQ ID NO: 13586 - DNA, 23 bp, Artificial Sequence
  Synthetic construct
gagacgacaaccatgccaaacgt

SEQ ID NO: 13587 - DNA, 23 bp, Artificial Sequence
  Synthetic construct
agacgacaaccatgccaaacgtg

SEQ ID NO: 13588 - DNA, 23 bp, Artificial Sequence
  Synthetic construct
gacgacaaccatgccaaacgtgc

SEQ ID NO: 13589 - DNA, 23 bp, Artificial Sequence
  Synthetic construct
acgacaaccatgccaaacgtgca

SEQ ID NO: 13590 - DNA, 23 bp, Artificial Sequence
  Synthetic construct
cgacaaccatgccaaacgtgcat

SEQ ID NO: 13591 - DNA, 23 bp, Artificial Sequence
  Synthetic construct
gacaaccatgccaaacgtgcatc

SEQ ID NO: 13592 - DNA, 23 bp, Artificial Sequence
  Synthetic construct
acaaccatgccaaacgtgcatcg

SEQ ID NO: 13593 - DNA, 23 bp, Artificial Sequence
  Synthetic construct
caaccatgccaaacgtgcatcgt

SEQ ID NO: 13594 - DNA, 23 bp, Artificial Sequence
  Synthetic construct
aaccatgccaaacgtgcatcgtt

SEQ ID NO: 13595 - DNA, 23 bp, Artificial Sequence
  Synthetic construct
accatgccaaacgtgcatcgttt

SEQ ID NO: 13596 - DNA, 23 bp, Artificial Sequence
  Synthetic construct
ccatgccaaacgtgcatcgttta

SEQ ID NO: 13597 - DNA, 23 bp, Artificial Sequence
  Synthetic construct
catgccaaacgtgcatcgtttat

SEQ ID NO: 13598 - DNA, 23 bp, Artificial Sequence
  Synthetic construct
atgccaaacgtgcatcgtttatg

SEQ ID NO: 13599 - DNA, 23 bp, Artificial Sequence
  Synthetic construct
tgccaaacgtgcatcgtttatgt

SEQ ID NO: 13600 - DNA, 23 bp, Artificial Sequence
  Synthetic construct
gccaaacgtgcatcgtttatgta

SEQ ID NO: 13601 - DNA, 23 bp, Artificial Sequence
  Synthetic construct
ccaaacgtgcatcgtttatgtaa

SEQ ID NO: 13602 - DNA, 23 bp, Artificial Sequence
  Synthetic construct
caaacgtgcatcgtttatgtaaa

SEQ ID NO: 13603 - DNA, 23 bp, Artificial Sequence
  Synthetic construct
aaacgtgcatcgtttatgtaaaa

SEQ ID NO: 13604 - DNA, 23 bp, Artificial Sequence
  Synthetic construct
aacgtgcatcgtttatgtaaaac

SEQ ID NO: 13605 - DNA, 23 bp, Artificial Sequence
  Synthetic construct
acgtgcatcgtttatgtaaaacc

SEQ ID NO: 13606 - DNA, 23 bp, Artificial Sequence
  Synthetic construct
cgtgcatcgtttatgtaaaacca

SEQ ID NO: 13607 - DNA, 23 bp, Artificial Sequence
  Synthetic construct
gtgcatcgtttatgtaaaaccat

SEQ ID NO: 13608 - DNA, 23 bp, Artificial Sequence
  Synthetic construct
tgcatcgtttatgtaaaaccata

SEQ ID NO: 13609 - DNA, 23 bp, Artificial Sequence
  Synthetic construct
gcatcgtttatgtaaaaccatat

SEQ ID NO: 13610 - DNA, 23 bp, Artificial Sequence
  Synthetic construct
catcgtttatgtaaaaccatatc

SEQ ID NO: 13611 - DNA, 23 bp, Artificial Sequence
  Synthetic construct
atcgtttatgtaaaaccatatca

SEQ ID NO: 13612 - DNA, 23 bp, Artificial Sequence
  Synthetic construct
tcgtttatgtaaaaccatatcac

SEQ ID NO: 13613 - DNA, 23 bp, Artificial Sequence
  Synthetic construct
cgtttatgtaaaaccatatcacg

SEQ ID NO: 13614 - DNA, 23 bp, Artificial Sequence
  Synthetic construct
gtttatgtaaaaccatatcacga

SEQ ID NO: 13615 - DNA, 23 bp, Artificial Sequence
  Synthetic construct
tttatgtaaaaccatatcacgat

SEQ ID NO: 13616 - DNA, 23 bp, Artificial Sequence
  Synthetic construct
ttatgtaaaaccatatcacgata

SEQ ID NO: 13617 - DNA, 23 bp, Artificial Sequence
  Synthetic construct
tatgtaaaaccatatcacgatac

SEQ ID NO: 13618 - DNA, 23 bp, Artificial Sequence
  Synthetic construct
atgtaaaaccatatcacgatacg

SEQ ID NO: 13619 - DNA, 23 bp, Artificial Sequence
  Synthetic construct
tgtaaaaccatatcacgatacgt

SEQ ID NO: 13620 - DNA, 23 bp, Artificial Sequence
  Synthetic construct
gtaaaaccatatcacgatacgtc

SEQ ID NO: 13621 - DNA, 23 bp, Artificial Sequence
  Synthetic construct
taaaaccatatcacgatacgtcg

SEQ ID NO: 13622 - DNA, 23 bp, Artificial Sequence
  Synthetic construct
aaaaccatatcacgatacgtcgc

SEQ ID NO: 13623 - DNA, 23 bp, Artificial Sequence
  Synthetic construct
aaaccatatcacgatacgtcgcg

SEQ ID NO: 13624 - DNA, 23 bp, Artificial Sequence
  Synthetic construct
aaccatatcacgatacgtcgcga

SEQ ID NO: 13625 - DNA, 23 bp, Artificial Sequence
  Synthetic construct
accatatcacgatacgtcgcgat

SEQ ID NO: 13626 - DNA, 23 bp, Artificial Sequence
  Synthetic construct
ccatatcacgatacgtcgcgata

SEQ ID NO: 13627 - DNA, 23 bp, Artificial Sequence
  Synthetic construct
catatcacgatacgtcgcgatat

SEQ ID NO: 13628 - DNA, 23 bp, Artificial Sequence
  Synthetic construct
atatcacgatacgtcgcgatatg

SEQ ID NO: 13629 - DNA, 23 bp, Artificial Sequence
  Synthetic construct
tatcacgatacgtcgcgatatgt

SEQ ID NO: 13630 - DNA, 23 bp, Artificial Sequence
  Synthetic construct
atcacgatacgtcgcgatatgtt

SEQ ID NO: 13631 - DNA, 23 bp, Artificial Sequence
  Synthetic construct
tcacgatacgtcgcgatatgttg

SEQ ID NO: 13632 - DNA, 23 bp, Artificial Sequence
  Synthetic construct
cacgatacgtcgcgatatgttgc

SEQ ID NO: 13633 - DNA, 23 bp, Artificial Sequence
  Synthetic construct
acgatacgtcgcgatatgttgca

SEQ ID NO: 13634 - DNA, 23 bp, Artificial Sequence
  Synthetic construct
cgatacgtcgcgatatgttgcac

SEQ ID NO: 13635 - DNA, 23 bp, Artificial Sequence
  Synthetic construct
gatacgtcgcgatatgttgcacg

SEQ ID NO: 13636 - DNA, 23 bp, Artificial Sequence
  Synthetic construct
atacgtcgcgatatgttgcacgt

SEQ ID NO: 13637 - DNA, 23 bp, Artificial Sequence
  Synthetic construct
tacgtcgcgatatgttgcacgtt

SEQ ID NO: 13638 - DNA, 23 bp, Artificial Sequence
  Synthetic construct
acgtcgcgatatgttgcacgttg

SEQ ID NO: 13639 - DNA, 23 bp, Artificial Sequence
  Synthetic construct
cgtcgcgatatgttgcacgttgt

SEQ ID NO: 13640 - DNA, 23 bp, Artificial Sequence
  Synthetic construct
gtcgcgatatgttgcacgttgtc

SEQ ID NO: 13641 - DNA, 23 bp, Artificial Sequence
  Synthetic construct
tcgcgatatgttgcacgttgtct

SEQ ID NO: 13642 - DNA, 23 bp, Artificial Sequence
  Synthetic construct
cgcgatatgttgcacgttgtctg

SEQ ID NO: 13643 - DNA, 23 bp, Artificial Sequence
  Synthetic construct
gcgatatgttgcacgttgtctgg

SEQ ID NO: 13644 - DNA, 23 bp, Artificial Sequence
  Synthetic construct
cgatatgttgcacgttgtctgga

SEQ ID NO: 13645 - DNA, 23 bp, Artificial Sequence
  Synthetic construct
gatatgttgcacgttgtctggaa

SEQ ID NO: 13646 - DNA, 23 bp, Artificial Sequence
  Synthetic construct
atatgttgcacgttgtctggaag

SEQ ID NO: 13647 - DNA, 23 bp, Artificial Sequence
  Synthetic construct
tatgttgcacgttgtctggaagt

SEQ ID NO: 13648 - DNA, 23 bp, Artificial Sequence
  Synthetic construct
atgttgcacgttgtctggaagtt

SEQ ID NO: 13649 - DNA, 23 bp, Artificial Sequence
  Synthetic construct
tgttgcacgttgtctggaagttt

SEQ ID NO: 13650 - DNA, 23 bp, Artificial Sequence
  Synthetic construct
gttgcacgttgtctggaagtttg

SEQ ID NO: 13651 - DNA, 23 bp, Artificial Sequence
  Synthetic construct
ttgcacgttgtctggaagtttgc

SEQ ID NO: 13652 - DNA, 23 bp, Artificial Sequence
  Synthetic construct
tgcacgttgtctggaagtttgca

SEQ ID NO: 13653 - DNA, 23 bp, Artificial Sequence
  Synthetic construct
gcacgttgtctggaagtttgcag

SEQ ID NO: 13654 - DNA, 23 bp, Artificial Sequence
  Synthetic construct
cacgttgtctggaagtttgcagc

SEQ ID NO: 13655 - DNA, 23 bp, Artificial Sequence
  Synthetic construct
acgttgtctggaagtttgcagct

SEQ ID NO: 13656 - DNA, 23 bp, Artificial Sequence
  Synthetic construct
cgttgtctggaagtttgcagctg

SEQ ID NO: 13657 - DNA, 23 bp, Artificial Sequence
  Synthetic construct
gttgtctggaagtttgcagctgg

SEQ ID NO: 13658 - DNA, 23 bp, Artificial Sequence
  Synthetic construct
ttgtctggaagtttgcagctgga

SEQ ID NO: 13659 - DNA, 23 bp, Artificial Sequence
  Synthetic construct
tgtctggaagtttgcagctggat

SEQ ID NO: 13660 - DNA, 23 bp, Artificial Sequence
  Synthetic construct
gtctggaagtttgcagctggata

SEQ ID NO: 13661 - DNA, 23 bp, Artificial Sequence
  Synthetic construct
tctggaagtttgcagctggatac

SEQ ID NO: 13662 - DNA, 23 bp, Artificial Sequence
  Synthetic construct
ctggaagtttgcagctggatacg

SEQ ID NO: 13663 - DNA, 23 bp, Artificial Sequence
  Synthetic construct
tggaagtttgcagctggatacga

SEQ ID NO: 13664 - DNA, 23 bp, Artificial Sequence
  Synthetic construct
ggaagtttgcagctggatacgac

SEQ ID NO: 13665 - DNA, 23 bp, Artificial Sequence
  Synthetic construct
gaagtttgcagctggatacgaca

SEQ ID NO: 13666 - DNA, 23 bp, Artificial Sequence
  Synthetic construct
aagtttgcagctggatacgacag

SEQ ID NO: 13667 - DNA, 23 bp, Artificial Sequence
  Synthetic construct
agtttgcagctggatacgacaga

SEQ ID NO: 13668 - DNA, 23 bp, Artificial Sequence
  Synthetic construct
gtttgcagctggatacgacagac

SEQ ID NO: 13669 - DNA, 23 bp, Artificial Sequence
  Synthetic construct
tttgcagctggatacgacagacg

SEQ ID NO: 13670 - DNA, 23 bp, Artificial Sequence
  Synthetic construct
ttgcagctggatacgacagacgg

SEQ ID NO: 13671 - DNA, 23 bp, Artificial Sequence
  Synthetic construct
tgcagctggatacgacagacggc

SEQ ID NO: 13672 - DNA, 23 bp, Artificial Sequence
  Synthetic construct
gcagctggatacgacagacggcc

SEQ ID NO: 13673 - DNA, 23 bp, Artificial Sequence
  Synthetic construct
cagctggatacgacagacggcca

SEQ ID NO: 13674 - DNA, 23 bp, Artificial Sequence
  Synthetic construct
agctggatacgacagacggccat

SEQ ID NO: 13675 - DNA, 23 bp, Artificial Sequence
  Synthetic construct
gctggatacgacagacggccatc

SEQ ID NO: 13676 - DNA, 23 bp, Artificial Sequence
  Synthetic construct
ctggatacgacagacggccatct

SEQ ID NO: 13677 - DNA, 23 bp, Artificial Sequence
  Synthetic construct
tggatacgacagacggccatcta

SEQ ID NO: 13678 - DNA, 23 bp, Artificial Sequence
  Synthetic construct
ggatacgacagacggccatctaa

SEQ ID NO: 13679 - DNA, 23 bp, Artificial Sequence
  Synthetic construct
gatacgacagacggccatctaac

SEQ ID NO: 13680 - DNA, 23 bp, Artificial Sequence
  Synthetic construct
atacgacagacggccatctaact

SEQ ID NO: 13681 - DNA, 23 bp, Artificial Sequence
  Synthetic construct
tacgacagacggccatctaactt

SEQ ID NO: 13682 - DNA, 23 bp, Artificial Sequence
  Synthetic construct
acgacagacggccatctaacttg

SEQ ID NO: 13683 - DNA, 23 bp, Artificial Sequence
  Synthetic construct
cgacagacggccatctaacttga

SEQ ID NO: 13684 - DNA, 23 bp, Artificial Sequence
  Synthetic construct
gacagacggccatctaacttgat

SEQ ID NO: 13685 - DNA, 23 bp, Artificial Sequence
  Synthetic construct
acagacggccatctaacttgatg

SEQ ID NO: 13686 - DNA, 23 bp, Artificial Sequence
  Synthetic construct
cagacggccatctaacttgatgt

SEQ ID NO: 13687 - DNA, 23 bp, Artificial Sequence
  Synthetic construct
agacggccatctaacttgatgtt

SEQ ID NO: 13688 - DNA, 23 bp, Artificial Sequence
  Synthetic construct
gacggccatctaacttgatgtta

SEQ ID NO: 13689 - DNA, 23 bp, Artificial Sequence
  Synthetic construct
acggccatctaacttgatgttag

SEQ ID NO: 13690 - DNA, 23 bp, Artificial Sequence
  Synthetic construct
cggccatctaacttgatgttagt

SEQ ID NO: 13691 - DNA, 23 bp, Artificial Sequence
  Synthetic construct
ggccatctaacttgatgttagta

SEQ ID NO: 13692 - DNA, 23 bp, Artificial Sequence
  Synthetic construct
gccatctaacttgatgttagtac

SEQ ID NO: 13693 - DNA, 23 bp, Artificial Sequence
  Synthetic construct
ccatctaacttgatgttagtacc

SEQ ID NO: 13694 - DNA, 23 bp, Artificial Sequence
  Synthetic construct
catctaacttgatgttagtaccg

SEQ ID NO: 13695 - DNA, 23 bp, Artificial Sequence
  Synthetic construct
atctaacttgatgttagtaccga

SEQ ID NO: 13696 - DNA, 23 bp, Artificial Sequence
  Synthetic construct
tctaacttgatgttagtaccgac

SEQ ID NO: 13697 - DNA, 23 bp, Artificial Sequence
  Synthetic construct
ctaacttgatgttagtaccgacc

SEQ ID NO: 13698 - DNA, 23 bp, Artificial Sequence
  Synthetic construct
taacttgatgttagtaccgacct

SEQ ID NO: 13699 - DNA, 23 bp, Artificial Sequence
  Synthetic construct
aacttgatgttagtaccgacctg

SEQ ID NO: 13700 - DNA, 23 bp, Artificial Sequence
  Synthetic construct
acttgatgttagtaccgacctga

SEQ ID NO: 13701 - DNA, 23 bp, Artificial Sequence
  Synthetic construct
cttgatgttagtaccgacctgac

SEQ ID NO: 13702 - DNA, 23 bp, Artificial Sequence
  Synthetic construct
ttgatgttagtaccgacctgacg

SEQ ID NO: 13703 - DNA, 23 bp, Artificial Sequence
  Synthetic construct
tgatgttagtaccgacctgacgt

SEQ ID NO: 13704 - DNA, 23 bp, Artificial Sequence
  Synthetic construct
gatgttagtaccgacctgacgta

SEQ ID NO: 13705 - DNA, 23 bp, Artificial Sequence
  Synthetic construct
atgttagtaccgacctgacgtac

SEQ ID NO: 13706 - DNA, 23 bp, Artificial Sequence
  Synthetic construct
tgttagtaccgacctgacgtacg

SEQ ID NO: 13707 - DNA, 23 bp, Artificial Sequence
  Synthetic construct
gttagtaccgacctgacgtacgg

SEQ ID NO: 13708 - DNA, 23 bp, Artificial Sequence
  Synthetic construct
ttagtaccgacctgacgtacggc

SEQ ID NO: 13709 - DNA, 23 bp, Artificial Sequence
  Synthetic construct
tagtaccgacctgacgtacggct

SEQ ID NO: 13710 - DNA, 23 bp, Artificial Sequence
  Synthetic construct
agtaccgacctgacgtacggctc

SEQ ID NO: 13711 - DNA, 23 bp, Artificial Sequence
  Synthetic construct
gtaccgacctgacgtacggctct

SEQ ID NO: 13712 - DNA, 23 bp, Artificial Sequence
  Synthetic construct
taccgacctgacgtacggctctc

SEQ ID NO: 13713 - DNA, 23 bp, Artificial Sequence
  Synthetic construct
accgacctgacgtacggctctca

SEQ ID NO: 13714 - DNA, 23 bp, Artificial Sequence
  Synthetic construct
ccgacctgacgtacggctctcat

SEQ ID NO: 13715 - DNA, 23 bp, Artificial Sequence
  Synthetic construct
cgacctgacgtacggctctcata

SEQ ID NO: 13716 - DNA, 23 bp, Artificial Sequence
  Synthetic construct
gacctgacgtacggctctcatag

SEQ ID NO: 13717 - DNA, 23 bp, Artificial Sequence
  Synthetic construct
acctgacgtacggctctcatagg

SEQ ID NO: 13718 - DNA, 23 bp, Artificial Sequence
  Synthetic construct
cctgacgtacggctctcatagga

SEQ ID NO: 13719 - DNA, 23 bp, Artificial Sequence
  Synthetic construct
ctgacgtacggctctcataggaa

SEQ ID NO: 13720 - DNA, 23 bp, Artificial Sequence
  Synthetic construct
tgacgtacggctctcataggaag

SEQ ID NO: 13721 - DNA, 23 bp, Artificial Sequence
  Synthetic construct
gacgtacggctctcataggaaga

SEQ ID NO: 13722 - DNA, 23 bp, Artificial Sequence
  Synthetic construct
acgtacggctctcataggaagaa

SEQ ID NO: 13723 - DNA, 23 bp, Artificial Sequence
  Synthetic construct
cgtacggctctcataggaagaaa

SEQ ID NO: 13724 - DNA, 23 bp, Artificial Sequence
  Synthetic construct
gtacggctctcataggaagaaac

SEQ ID NO: 13725 - DNA, 23 bp, Artificial Sequence
  Synthetic construct
tacggctctcataggaagaaact

SEQ ID NO: 13726 - DNA, 23 bp, Artificial Sequence
  Synthetic construct
acggctctcataggaagaaactc

SEQ ID NO: 13727 - DNA, 23 bp, Artificial Sequence
  Synthetic construct
cggctctcataggaagaaactct

SEQ ID NO: 13728 - DNA, 23 bp, Artificial Sequence
  Synthetic construct
ggctctcataggaagaaactctt

SEQ ID NO: 13729 - DNA, 23 bp, Artificial Sequence
  Synthetic construct
gctctcataggaagaaactcttg

SEQ ID NO: 13730 - DNA, 23 bp, Artificial Sequence
  Synthetic construct
ctctcataggaagaaactcttga

SEQ ID NO: 13731 - DNA, 23 bp, Artificial Sequence
  Synthetic construct
tctcataggaagaaactcttgaa

SEQ ID NO: 13732 - DNA, 23 bp, Artificial Sequence
  Synthetic construct
ctcataggaagaaactcttgaag

SEQ ID NO: 13733 - DNA, 23 bp, Artificial Sequence
  Synthetic construct
tcataggaagaaactcttgaagg

SEQ ID NO: 13734 - DNA, 23 bp, Artificial Sequence
  Synthetic construct
cataggaagaaactcttgaaggt

SEQ ID NO: 13735 - DNA, 23 bp, Artificial Sequence
  Synthetic construct
ataggaagaaactcttgaaggtg

SEQ ID NO: 13736 - DNA, 23 bp, Artificial Sequence
  Synthetic construct
taggaagaaactcttgaaggtga

SEQ ID NO: 13737 - DNA, 23 bp, Artificial Sequence
  Synthetic construct
aggaagaaactcttgaaggtgaa

SEQ ID NO: 13738 - DNA, 23 bp, Artificial Sequence
  Synthetic construct
ggaagaaactcttgaaggtgaac

SEQ ID NO: 13739 - DNA, 23 bp, Artificial Sequence
  Synthetic construct
gaagaaactcttgaaggtgaacc

SEQ ID NO: 13740 - DNA, 23 bp, Artificial Sequence
  Synthetic construct
aagaaactcttgaaggtgaacct

SEQ ID NO: 13741 - DNA, 23 bp, Artificial Sequence
  Synthetic construct
agaaactcttgaaggtgaacctt

SEQ ID NO: 13742 - DNA, 23 bp, Artificial Sequence
  Synthetic construct
gaaactcttgaaggtgaaccttc

SEQ ID NO: 13743 - DNA, 23 bp, Artificial Sequence
  Synthetic construct
aaactcttgaaggtgaaccttcg

SEQ ID NO: 13744 - DNA, 23 bp, Artificial Sequence
  Synthetic construct
aactcttgaaggtgaaccttcgt

SEQ ID NO: 13745 - DNA, 23 bp, Artificial Sequence
  Synthetic construct
actcttgaaggtgaaccttcgta

SEQ ID NO: 13746 - DNA, 23 bp, Artificial Sequence
  Synthetic construct
ctcttgaaggtgaaccttcgtaa

SEQ ID NO: 13747 - DNA, 23 bp, Artificial Sequence
  Synthetic construct
tcttgaaggtgaaccttcgtaag

SEQ ID NO: 13748 - DNA, 23 bp, Artificial Sequence
  Synthetic construct
cttgaaggtgaaccttcgtaagc

SEQ ID NO: 13749 - DNA, 23 bp, Artificial Sequence
  Synthetic construct
ttgaaggtgaaccttcgtaagca

SEQ ID NO: 13750 - DNA, 23 bp, Artificial Sequence
  Synthetic construct
tgaaggtgaaccttcgtaagcat

SEQ ID NO: 13751 - DNA, 23 bp, Artificial Sequence
  Synthetic construct
gaaggtgaaccttcgtaagcatc

SEQ ID NO: 13752 - DNA, 23 bp, Artificial Sequence
  Synthetic construct
aaggtgaaccttcgtaagcatct

SEQ ID NO: 13753 - DNA, 23 bp, Artificial Sequence
  Synthetic construct
aggtgaaccttcgtaagcatctc

SEQ ID NO: 13754 - DNA, 23 bp, Artificial Sequence
  Synthetic construct
ggtgaaccttcgtaagcatctca

SEQ ID NO: 13755 - DNA, 23 bp, Artificial Sequence
  Synthetic construct
gtgaaccttcgtaagcatctcat

SEQ ID NO: 13756 - DNA, 23 bp, Artificial Sequence
  Synthetic construct
tgaaccttcgtaagcatctcata

SEQ ID NO: 13757 - DNA, 23 bp, Artificial Sequence
  Synthetic construct
gaaccttcgtaagcatctcatat

SEQ ID NO: 13758 - DNA, 23 bp, Artificial Sequence
  Synthetic construct
aaccttcgtaagcatctcatatg

SEQ ID NO: 13759 - DNA, 23 bp, Artificial Sequence
  Synthetic construct
accttcgtaagcatctcatatgc

SEQ ID NO: 13760 - DNA, 23 bp, Artificial Sequence
  Synthetic construct
ccttcgtaagcatctcatatgca

SEQ ID NO: 13761 - DNA, 23 bp, Artificial Sequence
  Synthetic construct
cttcgtaagcatctcatatgcac

SEQ ID NO: 13762 - DNA, 23 bp, Artificial Sequence
  Synthetic construct
ttcgtaagcatctcatatgcacc

SEQ ID NO: 13763 - DNA, 23 bp, Artificial Sequence
  Synthetic construct
tcgtaagcatctcatatgcaccc

SEQ ID NO: 13764 - DNA, 23 bp, Artificial Sequence
  Synthetic construct
cgtaagcatctcatatgcaccct

SEQ ID NO: 13765 - DNA, 23 bp, Artificial Sequence
  Synthetic construct
gtaagcatctcatatgcaccctg

SEQ ID NO: 13766 - DNA, 23 bp, Artificial Sequence
  Synthetic construct
taagcatctcatatgcaccctgg

SEQ ID NO: 13767 - DNA, 23 bp, Artificial Sequence
  Synthetic construct
aagcatctcatatgcaccctgga

SEQ ID NO: 13768 - DNA, 23 bp, Artificial Sequence
  Synthetic construct
agcatctcatatgcaccctggat

SEQ ID NO: 13769 - DNA, 23 bp, Artificial Sequence
  Synthetic construct
gcatctcatatgcaccctggata

SEQ ID NO: 13770 - DNA, 23 bp, Artificial Sequence
  Synthetic construct
catctcatatgcaccctggatat

SEQ ID NO: 13771 - DNA, 23 bp, Artificial Sequence
  Synthetic construct
atctcatatgcaccctggatatc

SEQ ID NO: 13772 - DNA, 23 bp, Artificial Sequence
  Synthetic construct
tctcatatgcaccctggatatca

SEQ ID NO: 13773 - DNA, 23 bp, Artificial Sequence
  Synthetic construct
ctcatatgcaccctggatatcac

SEQ ID NO: 13774 - DNA, 23 bp, Artificial Sequence
  Synthetic construct
tcatatgcaccctggatatcact

SEQ ID NO: 13775 - DNA, 23 bp, Artificial Sequence
  Synthetic construct
catatgcaccctggatatcactc

SEQ ID NO: 13776 - DNA, 23 bp, Artificial Sequence
  Synthetic construct
atatgcaccctggatatcactca

SEQ ID NO: 13777 - DNA, 23 bp, Artificial Sequence
  Synthetic construct
tatgcaccctggatatcactcat

SEQ ID NO: 13778 - DNA, 23 bp, Artificial Sequence
  Synthetic construct
atgcaccctggatatcactcatt

SEQ ID NO: 13779 - DNA, 23 bp, Artificial Sequence
  Synthetic construct
tgcaccctggatatcactcatta

SEQ ID NO: 13780 - DNA, 23 bp, Artificial Sequence
  Synthetic construct
gcaccctggatatcactcattag

SEQ ID NO: 13781 - DNA, 23 bp, Artificial Sequence
  Synthetic construct
caccctggatatcactcattagt

SEQ ID NO: 13782 - DNA, 23 bp, Artificial Sequence
  Synthetic construct
accctggatatcactcattagtg

SEQ ID NO: 13783 - DNA, 23 bp, Artificial Sequence
  Synthetic construct
ccctggatatcactcattagtgg

SEQ ID NO: 13784 - DNA, 23 bp, Artificial Sequence
  Synthetic construct
cctggatatcactcattagtggt

SEQ ID NO: 13785 - DNA, 23 bp, Artificial Sequence
  Synthetic construct
ctggatatcactcattagtggta

SEQ ID NO: 13786 - DNA, 23 bp, Artificial Sequence
  Synthetic construct
tggatatcactcattagtggtaa

SEQ ID NO: 13787 - DNA, 23 bp, Artificial Sequence
  Synthetic construct
ggatatcactcattagtggtaac

SEQ ID NO: 13788 - DNA, 23 bp, Artificial Sequence
  Synthetic construct
gatatcactcattagtggtaacc

SEQ ID NO: 13789 - DNA, 23 bp, Artificial Sequence
  Synthetic construct
atatcactcattagtggtaacca

SEQ ID NO: 13790 - DNA, 23 bp, Artificial Sequence
  Synthetic construct
tatcactcattagtggtaaccaa

SEQ ID NO: 13791 - DNA, 23 bp, Artificial Sequence
  Synthetic construct
atcactcattagtggtaaccaac

SEQ ID NO: 13792 - DNA, 23 bp, Artificial Sequence
  Synthetic construct
tcactcattagtggtaaccaacc

SEQ ID NO: 13793 - DNA, 23 bp, Artificial Sequence
  Synthetic construct
cactcattagtggtaaccaaccg

SEQ ID NO: 13794 - DNA, 23 bp, Artificial Sequence
  Synthetic construct
actcattagtggtaaccaaccga

SEQ ID NO: 13795 - DNA, 23 bp, Artificial Sequence
  Synthetic construct
ctcattagtggtaaccaaccgaa

SEQ ID NO: 13796 - DNA, 23 bp, Artificial Sequence
  Synthetic construct
tcattagtggtaaccaaccgaac

SEQ ID NO: 13797 - DNA, 23 bp, Artificial Sequence
  Synthetic construct
cattagtggtaaccaaccgaact

SEQ ID NO: 13798 - DNA, 23 bp, Artificial Sequence
  Synthetic construct
attagtggtaaccaaccgaactg

SEQ ID NO: 13799 - DNA, 23 bp, Artificial Sequence
  Synthetic construct
ttagtggtaaccaaccgaactgc

SEQ ID NO: 13800 - DNA, 23 bp, Artificial Sequence
  Synthetic construct
tagtggtaaccaaccgaactgca

SEQ ID NO: 13801 - DNA, 23 bp, Artificial Sequence
  Synthetic construct
agtggtaaccaaccgaactgcaa

SEQ ID NO: 13802 - DNA, 23 bp, Artificial Sequence
  Synthetic construct
gtggtaaccaaccgaactgcaac

SEQ ID NO: 13803 - DNA, 23 bp, Artificial Sequence
  Synthetic construct
tggtaaccaaccgaactgcaact

SEQ ID NO: 13804 - DNA, 23 bp, Artificial Sequence
  Synthetic construct
ggtaaccaaccgaactgcaactc

SEQ ID NO: 13805 - DNA, 23 bp, Artificial Sequence
  Synthetic construct
gtaaccaaccgaactgcaactcc

SEQ ID NO: 13806 - DNA, 23 bp, Artificial Sequence
  Synthetic construct
taaccaaccgaactgcaactcca

SEQ ID NO: 13807 - DNA, 23 bp, Artificial Sequence
  Synthetic construct
aaccaaccgaactgcaactccaa

SEQ ID NO: 13808 - DNA, 23 bp, Artificial Sequence
  Synthetic construct
accaaccgaactgcaactccaac

SEQ ID NO: 13809 - DNA, 23 bp, Artificial Sequence
  Synthetic construct
ccaaccgaactgcaactccaacc

SEQ ID NO: 13810 - DNA, 23 bp, Artificial Sequence
  Synthetic construct
caaccgaactgcaactccaacca

SEQ ID NO: 13811 - DNA, 23 bp, Artificial Sequence
  Synthetic construct
aaccgaactgcaactccaaccac

SEQ ID NO: 13812 - DNA, 23 bp, Artificial Sequence
  Synthetic construct
accgaactgcaactccaaccacc

SEQ ID NO: 13813 - DNA, 23 bp, Artificial Sequence
  Synthetic construct
ccgaactgcaactccaaccacct

SEQ ID NO: 13814 - DNA, 23 bp, Artificial Sequence
  Synthetic construct
cgaactgcaactccaaccacctg

SEQ ID NO: 13815 - DNA, 23 bp, Artificial Sequence
  Synthetic construct
gaactgcaactccaaccacctgc

SEQ ID NO: 13816 - DNA, 23 bp, Artificial Sequence
  Synthetic construct
aactgcaactccaaccacctgcc

SEQ ID NO: 13817 - DNA, 23 bp, Artificial Sequence
  Synthetic construct
actgcaactccaaccacctgccg

SEQ ID NO: 13818 - DNA, 23 bp, Artificial Sequence
  Synthetic construct
ctgcaactccaaccacctgccgg

SEQ ID NO: 13819 - DNA, 23 bp, Artificial Sequence
  Synthetic construct
tgcaactccaaccacctgccggc

SEQ ID NO: 13820 - DNA, 23 bp, Artificial Sequence
  Synthetic construct
gcaactccaaccacctgccggcc

SEQ ID NO: 13821 - DNA, 23 bp, Artificial Sequence
  Synthetic construct
caactccaaccacctgccggcca

SEQ ID NO: 13822 - DNA, 23 bp, Artificial Sequence
  Synthetic construct
aactccaaccacctgccggccac

SEQ ID NO: 13823 - DNA, 23 bp, Artificial Sequence
  Synthetic construct
actccaaccacctgccggccacg

SEQ ID NO: 13824 - DNA, 23 bp, Artificial Sequence
  Synthetic construct
ctccaaccacctgccggccacgt

SEQ ID NO: 13825 - DNA, 23 bp, Artificial Sequence
  Synthetic construct
tccaaccacctgccggccacgtg

SEQ ID NO: 13826 - DNA, 23 bp, Artificial Sequence
  Synthetic construct
ccaaccacctgccggccacgtgt

SEQ ID NO: 13827 - DNA, 23 bp, Artificial Sequence
  Synthetic construct
caaccacctgccggccacgtgtt

SEQ ID NO: 13828 - DNA, 23 bp, Artificial Sequence
  Synthetic construct
aaccacctgccggccacgtgttt

SEQ ID NO: 13829 - DNA, 23 bp, Artificial Sequence
  Synthetic construct
accacctgccggccacgtgtttt

SEQ ID NO: 13830 - DNA, 23 bp, Artificial Sequence
  Synthetic construct
ccacctgccggccacgtgttttg

SEQ ID NO: 13831 - DNA, 23 bp, Artificial Sequence
  Synthetic construct
cacctgccggccacgtgttttga

SEQ ID NO: 13832 - DNA, 23 bp, Artificial Sequence
  Synthetic construct
acctgccggccacgtgttttgat

SEQ ID NO: 13833 - DNA, 23 bp, Artificial Sequence
  Synthetic construct
cctgccggccacgtgttttgatc

SEQ ID NO: 13834 - DNA, 23 bp, Artificial Sequence
  Synthetic construct
ctgccggccacgtgttttgatcg

SEQ ID NO: 13835 - DNA, 23 bp, Artificial Sequence
  Synthetic construct
tgccggccacgtgttttgatcga

SEQ ID NO: 13836 - DNA, 23 bp, Artificial Sequence
  Synthetic construct
gccggccacgtgttttgatcgaa

SEQ ID NO: 13837 - DNA, 23 bp, Artificial Sequence
  Synthetic construct
ccggccacgtgttttgatcgaaa

SEQ ID NO: 13838 - DNA, 23 bp, Artificial Sequence
  Synthetic construct
cggccacgtgttttgatcgaaac

SEQ ID NO: 13839 - DNA, 23 bp, Artificial Sequence
  Synthetic construct
ggccacgtgttttgatcgaaact

SEQ ID NO: 13840 - DNA, 23 bp, Artificial Sequence
  Synthetic construct
gccacgtgttttgatcgaaactt

SEQ ID NO: 13841 - DNA, 23 bp, Artificial Sequence
  Synthetic construct
ccacgtgttttgatcgaaacttt

SEQ ID NO: 13842 - DNA, 23 bp, Artificial Sequence
  Synthetic construct
cacgtgttttgatcgaaactttc

SEQ ID NO: 13843 - DNA, 23 bp, Artificial Sequence
  Synthetic construct
acgtgttttgatcgaaactttcg

SEQ ID NO: 13844 - DNA, 23 bp, Artificial Sequence
  Synthetic construct
cgtgttttgatcgaaactttcga

SEQ ID NO: 13845 - DNA, 23 bp, Artificial Sequence
  Synthetic construct
gtgttttgatcgaaactttcgat

SEQ ID NO: 13846 - DNA, 23 bp, Artificial Sequence
  Synthetic construct
tgttttgatcgaaactttcgatc

SEQ ID NO: 13847 - DNA, 23 bp, Artificial Sequence
  Synthetic construct
gttttgatcgaaactttcgatct

SEQ ID NO: 13848 - DNA, 23 bp, Artificial Sequence
  Synthetic construct
ttttgatcgaaactttcgatctt

SEQ ID NO: 13849 - DNA, 23 bp, Artificial Sequence
  Synthetic construct
tttgatcgaaactttcgatcttc

SEQ ID NO: 13850 - DNA, 23 bp, Artificial Sequence
  Synthetic construct
ttgatcgaaactttcgatcttcg

SEQ ID NO: 13851 - DNA, 23 bp, Artificial Sequence
  Synthetic construct
tgatcgaaactttcgatcttcgt

SEQ ID NO: 13852 - DNA, 23 bp, Artificial Sequence
  Synthetic construct
gatcgaaactttcgatcttcgtt

SEQ ID NO: 13853 - DNA, 23 bp, Artificial Sequence
  Synthetic construct
atcgaaactttcgatcttcgttt

SEQ ID NO: 13854 - DNA, 23 bp, Artificial Sequence
  Synthetic construct
tcgaaactttcgatcttcgttta

SEQ ID NO: 13855 - DNA, 23 bp, Artificial Sequence
  Synthetic construct
cgaaactttcgatcttcgtttag

SEQ ID NO: 13856 - DNA, 23 bp, Artificial Sequence
  Synthetic construct
gaaactttcgatcttcgtttagg

SEQ ID NO: 13857 - DNA, 23 bp, Artificial Sequence
  Synthetic construct
aaactttcgatcttcgtttaggg

SEQ ID NO: 13858 - DNA, 23 bp, Artificial Sequence
  Synthetic construct
aactttcgatcttcgtttagggc

SEQ ID NO: 13859 - DNA, 23 bp, Artificial Sequence
  Synthetic construct
actttcgatcttcgtttagggca

SEQ ID NO: 13860 - DNA, 23 bp, Artificial Sequence
  Synthetic construct
ctttcgatcttcgtttagggcaa

SEQ ID NO: 13861 - DNA, 23 bp, Artificial Sequence
  Synthetic construct
tttcgatcttcgtttagggcaag

SEQ ID NO: 13862 - DNA, 23 bp, Artificial Sequence
  Synthetic construct
ttcgatcttcgtttagggcaagg

SEQ ID NO: 13863 - DNA, 23 bp, Artificial Sequence
  Synthetic construct
tcgatcttcgtttagggcaaggt

SEQ ID NO: 13864 - DNA, 23 bp, Artificial Sequence
  Synthetic construct
cgatcttcgtttagggcaaggta

SEQ ID NO: 13865 - DNA, 23 bp, Artificial Sequence
  Synthetic construct
gatcttcgtttagggcaaggtag

SEQ ID NO: 13866 - DNA, 23 bp, Artificial Sequence
  Synthetic construct
atcttcgtttagggcaaggtagc

SEQ ID NO: 13867 - DNA, 23 bp, Artificial Sequence
  Synthetic construct
tcttcgtttagggcaaggtagcg

SEQ ID NO: 13868 - DNA, 23 bp, Artificial Sequence
  Synthetic construct
cttcgtttagggcaaggtagcgg

SEQ ID NO: 13869 - DNA, 23 bp, Artificial Sequence
  Synthetic construct
ttcgtttagggcaaggtagcgga

SEQ ID NO: 13870 - DNA, 23 bp, Artificial Sequence
  Synthetic construct
tcgtttagggcaaggtagcggag

SEQ ID NO: 13871 - DNA, 23 bp, Artificial Sequence
  Synthetic construct
cgtttagggcaaggtagcggagc

SEQ ID NO: 13872 - DNA, 23 bp, Artificial Sequence
  Synthetic construct
gtttagggcaaggtagcggagcg

SEQ ID NO: 13873 - DNA, 23 bp, Artificial Sequence
  Synthetic construct
tttagggcaaggtagcggagcgc

SEQ ID NO: 13874 - DNA, 23 bp, Artificial Sequence
  Synthetic construct
ttagggcaaggtagcggagcgcc

SEQ ID NO: 13875 - DNA, 23 bp, Artificial Sequence
  Synthetic construct
tagggcaaggtagcggagcgcct

SEQ ID NO: 13876 - DNA, 23 bp, Artificial Sequence
  Synthetic construct
agggcaaggtagcggagcgcctg

SEQ ID NO: 13877 - DNA, 23 bp, Artificial Sequence
  Synthetic construct
gggcaaggtagcggagcgcctgg

SEQ ID NO: 13878 - DNA, 23 bp, Artificial Sequence
  Synthetic construct
ggcaaggtagcggagcgcctggc

SEQ ID NO: 13879 - DNA, 23 bp, Artificial Sequence
  Synthetic construct
gcaaggtagcggagcgcctggcg

SEQ ID NO: 13880 - DNA, 23 bp, Artificial Sequence
  Synthetic construct
caaggtagcggagcgcctggcgc

SEQ ID NO: 13881 - DNA, 23 bp, Artificial Sequence
  Synthetic construct
aaggtagcggagcgcctggcgcc

SEQ ID NO: 13882 - DNA, 23 bp, Artificial Sequence
  Synthetic construct
aggtagcggagcgcctggcgcca

SEQ ID NO: 13883 - DNA, 23 bp, Artificial Sequence
  Synthetic construct
ggtagcggagcgcctggcgccaa

SEQ ID NO: 13884 - DNA, 23 bp, Artificial Sequence
  Synthetic construct
gtagcggagcgcctggcgccaat

SEQ ID NO: 13885 - DNA, 23 bp, Artificial Sequence
  Synthetic construct
tagcggagcgcctggcgccaatt

SEQ ID NO: 13886 - DNA, 23 bp, Artificial Sequence
  Synthetic construct
agcggagcgcctggcgccaatta

SEQ ID NO: 13887 - DNA, 23 bp, Artificial Sequence
  Synthetic construct
gcggagcgcctggcgccaattac

SEQ ID NO: 13888 - DNA, 23 bp, Artificial Sequence
  Synthetic construct
cggagcgcctggcgccaattacc

SEQ ID NO: 13889 - DNA, 23 bp, Artificial Sequence
  Synthetic construct
ggagcgcctggcgccaattaccg

SEQ ID NO: 13890 - DNA, 23 bp, Artificial Sequence
  Synthetic construct
gagcgcctggcgccaattaccgc

SEQ ID NO: 13891 - DNA, 23 bp, Artificial Sequence
  Synthetic construct
agcgcctggcgccaattaccgcg

SEQ ID NO: 13892 - DNA, 23 bp, Artificial Sequence
  Synthetic construct
gcgcctggcgccaattaccgcga

SEQ ID NO: 13893 - DNA, 23 bp, Artificial Sequence
  Synthetic construct
cgcctggcgccaattaccgcgac

SEQ ID NO: 13894 - DNA, 23 bp, Artificial Sequence
  Synthetic construct
gcctggcgccaattaccgcgacg

SEQ ID NO: 13895 - DNA, 23 bp, Artificial Sequence
  Synthetic construct
cctggcgccaattaccgcgacga

SEQ ID NO: 13896 - DNA, 23 bp, Artificial Sequence
  Synthetic construct
ctggcgccaattaccgcgacgag

SEQ ID NO: 13897 - DNA, 23 bp, Artificial Sequence
  Synthetic construct
tggcgccaattaccgcgacgagc

SEQ ID NO: 13898 - DNA, 23 bp, Artificial Sequence
  Synthetic construct
ggcgccaattaccgcgacgagcg

SEQ ID NO: 13899 - DNA, 23 bp, Artificial Sequence
  Synthetic construct
gcgccaattaccgcgacgagcgg

SEQ ID NO: 13900 - DNA, 23 bp, Artificial Sequence
  Synthetic construct
cgccaattaccgcgacgagcggc

SEQ ID NO: 13901 - DNA, 23 bp, Artificial Sequence
  Synthetic construct
gccaattaccgcgacgagcggca

SEQ ID NO: 13902 - DNA, 23 bp, Artificial Sequence
  Synthetic construct
ccaattaccgcgacgagcggcag

SEQ ID NO: 13903 - DNA, 23 bp, Artificial Sequence
  Synthetic construct
caattaccgcgacgagcggcagt

SEQ ID NO: 13904 - DNA, 23 bp, Artificial Sequence
  Synthetic construct
aattaccgcgacgagcggcagtg

SEQ ID NO: 13905 - DNA, 23 bp, Artificial Sequence
  Synthetic construct
attaccgcgacgagcggcagtgt

SEQ ID NO: 13906 - DNA, 23 bp, Artificial Sequence
  Synthetic construct
ttaccgcgacgagcggcagtgta

SEQ ID NO: 13907 - DNA, 23 bp, Artificial Sequence
  Synthetic construct
taccgcgacgagcggcagtgtac

SEQ ID NO: 13908 - DNA, 23 bp, Artificial Sequence
  Synthetic construct
accgcgacgagcggcagtgtacg

SEQ ID NO: 13909 - DNA, 23 bp, Artificial Sequence
  Synthetic construct
ccgcgacgagcggcagtgtacgc

SEQ ID NO: 13910 - DNA, 23 bp, Artificial Sequence
  Synthetic construct
cgcgacgagcggcagtgtacgcc

SEQ ID NO: 13911 - DNA, 23 bp, Artificial Sequence
  Synthetic construct
gcgacgagcggcagtgtacgcct

SEQ ID NO: 13912 - DNA, 23 bp, Artificial Sequence
  Synthetic construct
cgacgagcggcagtgtacgcctt

SEQ ID NO: 13913 - DNA, 23 bp, Artificial Sequence
  Synthetic construct
gacgagcggcagtgtacgccttc

SEQ ID NO: 13914 - DNA, 23 bp, Artificial Sequence
  Synthetic construct
acgagcggcagtgtacgccttca

SEQ ID NO: 13915 - DNA, 23 bp, Artificial Sequence
  Synthetic construct
cgagcggcagtgtacgccttcac

SEQ ID NO: 13916 - DNA, 23 bp, Artificial Sequence
  Synthetic construct
gagcggcagtgtacgccttcacg

SEQ ID NO: 13917 - DNA, 23 bp, Artificial Sequence
  Synthetic construct
agcggcagtgtacgccttcacga

SEQ ID NO: 13918 - DNA, 23 bp, Artificial Sequence
  Synthetic construct
gcggcagtgtacgccttcacgag

SEQ ID NO: 13919 - DNA, 23 bp, Artificial Sequence
  Synthetic construct
cggcagtgtacgccttcacgagc

SEQ ID NO: 13920 - DNA, 23 bp, Artificial Sequence
  Synthetic construct
ggcagtgtacgccttcacgagcg

SEQ ID NO: 13921 - DNA, 23 bp, Artificial Sequence
  Synthetic construct
gcagtgtacgccttcacgagcgc

SEQ ID NO: 13922 - DNA, 23 bp, Artificial Sequence
  Synthetic construct
cagtgtacgccttcacgagcgca

SEQ ID NO: 13923 - DNA, 23 bp, Artificial Sequence
  Synthetic construct
agtgtacgccttcacgagcgcaa

SEQ ID NO: 13924 - DNA, 23 bp, Artificial Sequence
  Synthetic construct
gtgtacgccttcacgagcgcaat

SEQ ID NO: 13925 - DNA, 23 bp, Artificial Sequence
  Synthetic construct
tgtacgccttcacgagcgcaatg

SEQ ID NO: 13926 - DNA, 23 bp, Artificial Sequence
  Synthetic construct
gtacgccttcacgagcgcaatgg

SEQ ID NO: 13927 - DNA, 23 bp, Artificial Sequence
  Synthetic construct
tacgccttcacgagcgcaatggt

SEQ ID NO: 13928 - DNA, 23 bp, Artificial Sequence
  Synthetic construct
acgccttcacgagcgcaatggtt

SEQ ID NO: 13929 - DNA, 23 bp, Artificial Sequence
  Synthetic construct
cgccttcacgagcgcaatggttt

SEQ ID NO: 13930 - DNA, 23 bp, Artificial Sequence
  Synthetic construct
gccttcacgagcgcaatggtttg

SEQ ID NO: 13931 - DNA, 23 bp, Artificial Sequence
  Synthetic construct
ccttcacgagcgcaatggtttgc

SEQ ID NO: 13932 - DNA, 23 bp, Artificial Sequence
  Synthetic construct
cttcacgagcgcaatggtttgcg

SEQ ID NO: 13933 - DNA, 23 bp, Artificial Sequence
  Synthetic construct
ttcacgagcgcaatggtttgcgt

SEQ ID NO: 13934 - DNA, 23 bp, Artificial Sequence
  Synthetic construct
tcacgagcgcaatggtttgcgtc

SEQ ID NO: 13935 - DNA, 23 bp, Artificial Sequence
  Synthetic construct
cacgagcgcaatggtttgcgtcg

SEQ ID NO: 13936 - DNA, 23 bp, Artificial Sequence
  Synthetic construct
acgagcgcaatggtttgcgtcgc

SEQ ID NO: 13937 - DNA, 23 bp, Artificial Sequence
  Synthetic construct
cgagcgcaatggtttgcgtcgcg

SEQ ID NO: 13938 - DNA, 23 bp, Artificial Sequence
  Synthetic construct
gagcgcaatggtttgcgtcgcga

SEQ ID NO: 13939 - DNA, 23 bp, Artificial Sequence
  Synthetic construct
agcgcaatggtttgcgtcgcgag

SEQ ID NO: 13940 - DNA, 23 bp, Artificial Sequence
  Synthetic construct
gcgcaatggtttgcgtcgcgagt

SEQ ID NO: 13941 - DNA, 23 bp, Artificial Sequence
  Synthetic construct
cgcaatggtttgcgtcgcgagtt

SEQ ID NO: 13942 - DNA, 23 bp, Artificial Sequence
  Synthetic construct
gcaatggtttgcgtcgcgagttg

SEQ ID NO: 13943 - DNA, 23 bp, Artificial Sequence
  Synthetic construct
caatggtttgcgtcgcgagttgt

SEQ ID NO: 13944 - DNA, 23 bp, Artificial Sequence
  Synthetic construct
aatggtttgcgtcgcgagttgtg

SEQ ID NO: 13945 - DNA, 23 bp, Artificial Sequence
  Synthetic construct
atggtttgcgtcgcgagttgtga

SEQ ID NO: 13946 - DNA, 23 bp, Artificial Sequence
  Synthetic construct
tggtttgcgtcgcgagttgtgag

SEQ ID NO: 13947 - DNA, 23 bp, Artificial Sequence
  Synthetic construct
ggtttgcgtcgcgagttgtgagg

SEQ ID NO: 13948 - DNA, 23 bp, Artificial Sequence
  Synthetic construct
gtttgcgtcgcgagttgtgaggc

SEQ ID NO: 13949 - DNA, 23 bp, Artificial Sequence
  Synthetic construct
tttgcgtcgcgagttgtgaggct

SEQ ID NO: 13950 - DNA, 23 bp, Artificial Sequence
  Synthetic construct
ttgcgtcgcgagttgtgaggctg

SEQ ID NO: 13951 - DNA, 23 bp, Artificial Sequence
  Synthetic construct
tgcgtcgcgagttgtgaggctgt

SEQ ID NO: 13952 - DNA, 23 bp, Artificial Sequence
  Synthetic construct
gcgtcgcgagttgtgaggctgtc

SEQ ID NO: 13953 - DNA, 23 bp, Artificial Sequence
  Synthetic construct
cgtcgcgagttgtgaggctgtcg

SEQ ID NO: 13954 - DNA, 23 bp, Artificial Sequence
  Synthetic construct
gtcgcgagttgtgaggctgtcga

SEQ ID NO: 13955 - DNA, 23 bp, Artificial Sequence
  Synthetic construct
tcgcgagttgtgaggctgtcgac

SEQ ID NO: 13956 - DNA, 23 bp, Artificial Sequence
  Synthetic construct
cgcgagttgtgaggctgtcgacc

SEQ ID NO: 13957 - DNA, 23 bp, Artificial Sequence
  Synthetic construct
gcgagttgtgaggctgtcgacct

SEQ ID NO: 13958 - DNA, 23 bp, Artificial Sequence
  Synthetic construct
cgagttgtgaggctgtcgacctg

SEQ ID NO: 13959 - DNA, 23 bp, Artificial Sequence
  Synthetic construct
gagttgtgaggctgtcgacctgg

SEQ ID NO: 13960 - DNA, 23 bp, Artificial Sequence
  Synthetic construct
agttgtgaggctgtcgacctggc

SEQ ID NO: 13961 - DNA, 23 bp, Artificial Sequence
  Synthetic construct
gttgtgaggctgtcgacctggcc

SEQ ID NO: 13962 - DNA, 23 bp, Artificial Sequence
  Synthetic construct
ttgtgaggctgtcgacctggcct

SEQ ID NO: 13963 - DNA, 23 bp, Artificial Sequence
  Synthetic construct
tgtgaggctgtcgacctggcctc

SEQ ID NO: 13964 - DNA, 23 bp, Artificial Sequence
  Synthetic construct
gtgaggctgtcgacctggcctct

SEQ ID NO: 13965 - DNA, 23 bp, Artificial Sequence
  Synthetic construct
tgaggctgtcgacctggcctctg

SEQ ID NO: 13966 - DNA, 23 bp, Artificial Sequence
  Synthetic construct
gaggctgtcgacctggcctctgc

SEQ ID NO: 13967 - DNA, 23 bp, Artificial Sequence
  Synthetic construct
aggctgtcgacctggcctctgct

SEQ ID NO: 13968 - DNA, 23 bp, Artificial Sequence
  Synthetic construct
ggctgtcgacctggcctctgcta

SEQ ID NO: 13969 - DNA, 23 bp, Artificial Sequence
  Synthetic construct
gctgtcgacctggcctctgctaa

SEQ ID NO: 13970 - DNA, 23 bp, Artificial Sequence
  Synthetic construct
ctgtcgacctggcctctgctaaa

SEQ ID NO: 13971 - DNA, 23 bp, Artificial Sequence
  Synthetic construct
tgtcgacctggcctctgctaaag

SEQ ID NO: 13972 - DNA, 23 bp, Artificial Sequence
  Synthetic construct
gtcgacctggcctctgctaaagc

SEQ ID NO: 13973 - DNA, 23 bp, Artificial Sequence
  Synthetic construct
tcgacctggcctctgctaaagca

SEQ ID NO: 13974 - DNA, 23 bp, Artificial Sequence
  Synthetic construct
cgacctggcctctgctaaagcaa

SEQ ID NO: 13975 - DNA, 23 bp, Artificial Sequence
  Synthetic construct
gacctggcctctgctaaagcaac

SEQ ID NO: 13976 - DNA, 23 bp, Artificial Sequence
  Synthetic construct
acctggcctctgctaaagcaaca

SEQ ID NO: 13977 - DNA, 23 bp, Artificial Sequence
  Synthetic construct
cctggcctctgctaaagcaacac

SEQ ID NO: 13978 - DNA, 23 bp, Artificial Sequence
  Synthetic construct
ctggcctctgctaaagcaacacc

SEQ ID NO: 13979 - DNA, 23 bp, Artificial Sequence
  Synthetic construct
tggcctctgctaaagcaacacca

SEQ ID NO: 13980 - DNA, 23 bp, Artificial Sequence
  Synthetic construct
ggcctctgctaaagcaacaccaa

SEQ ID NO: 13981 - DNA, 23 bp, Artificial Sequence
  Synthetic construct
gcctctgctaaagcaacaccaag

SEQ ID NO: 13982 - DNA, 23 bp, Artificial Sequence
  Synthetic construct
cctctgctaaagcaacaccaagg

SEQ ID NO: 13983 - DNA, 23 bp, Artificial Sequence
  Synthetic construct
ctctgctaaagcaacaccaaggt

SEQ ID NO: 13984 - DNA, 23 bp, Artificial Sequence
  Synthetic construct
tctgctaaagcaacaccaaggtt

SEQ ID NO: 13985 - DNA, 23 bp, Artificial Sequence
  Synthetic construct
ctgctaaagcaacaccaaggtta

SEQ ID NO: 13986 - DNA, 23 bp, Artificial Sequence
  Synthetic construct
tgctaaagcaacaccaaggttaa

SEQ ID NO: 13987 - DNA, 23 bp, Artificial Sequence
  Synthetic construct
gctaaagcaacaccaaggttaaa

SEQ ID NO: 13988 - DNA, 23 bp, Artificial Sequence
  Synthetic construct
ctaaagcaacaccaaggttaaaa

SEQ ID NO: 13989 - DNA, 23 bp, Artificial Sequence
  Synthetic construct
taaagcaacaccaaggttaaaat

SEQ ID NO: 13990 - DNA, 23 bp, Artificial Sequence
  Synthetic construct
aaagcaacaccaaggttaaaatt

SEQ ID NO: 13991 - DNA, 23 bp, Artificial Sequence
  Synthetic construct
aagcaacaccaaggttaaaatta

SEQ ID NO: 13992 - DNA, 23 bp, Artificial Sequence
  Synthetic construct
agcaacaccaaggttaaaattac

SEQ ID NO: 13993 - DNA, 23 bp, Artificial Sequence
  Synthetic construct
gcaacaccaaggttaaaattacc

SEQ ID NO: 13994 - DNA, 23 bp, Artificial Sequence
  Synthetic construct
caacaccaaggttaaaattaccc

SEQ ID NO: 13995 - DNA, 23 bp, Artificial Sequence
  Synthetic construct
aacaccaaggttaaaattaccct

SEQ ID NO: 13996 - DNA, 23 bp, Artificial Sequence
  Synthetic construct
acaccaaggttaaaattaccctg

SEQ ID NO: 13997 - DNA, 23 bp, Artificial Sequence
  Synthetic construct
caccaaggttaaaattaccctgg

SEQ ID NO: 13998 - DNA, 23 bp, Artificial Sequence
  Synthetic construct
accaaggttaaaattaccctggg

SEQ ID NO: 13999 - DNA, 23 bp, Artificial Sequence
  Synthetic construct
ccaaggttaaaattaccctgggt

SEQ ID NO: 14000 - DNA, 23 bp, Artificial Sequence
  Synthetic construct
caaggttaaaattaccctgggtg

SEQ ID NO: 14001 - DNA, 23 bp, Artificial Sequence
  Synthetic construct
aaggttaaaattaccctgggtga

SEQ ID NO: 14002 - DNA, 23 bp, Artificial Sequence
  Synthetic construct
aggttaaaattaccctgggtgac

SEQ ID NO: 14003 - DNA, 23 bp, Artificial Sequence
  Synthetic construct
ggttaaaattaccctgggtgacc

SEQ ID NO: 14004 - DNA, 23 bp, Artificial Sequence
  Synthetic construct
gttaaaattaccctgggtgacct

SEQ ID NO: 14005 - DNA, 23 bp, Artificial Sequence
  Synthetic construct
ttaaaattaccctgggtgacctt

SEQ ID NO: 14006 - DNA, 23 bp, Artificial Sequence
  Synthetic construct
taaaattaccctgggtgaccttt

SEQ ID NO: 14007 - DNA, 23 bp, Artificial Sequence
  Synthetic construct
aaaattaccctgggtgacctttt

SEQ ID NO: 14008 - DNA, 23 bp, Artificial Sequence
  Synthetic construct
aaattaccctgggtgaccttttg

SEQ ID NO: 14009 - DNA, 23 bp, Artificial Sequence
  Synthetic construct
aattaccctgggtgaccttttgc

SEQ ID NO: 14010 - DNA, 23 bp, Artificial Sequence
  Synthetic construct
attaccctgggtgaccttttgca

SEQ ID NO: 14011 - DNA, 23 bp, Artificial Sequence
  Synthetic construct
ttaccctgggtgaccttttgcag

SEQ ID NO: 14012 - DNA, 23 bp, Artificial Sequence
  Synthetic construct
taccctgggtgaccttttgcagg

SEQ ID NO: 14013 - DNA, 23 bp, Artificial Sequence
  Synthetic construct
accctgggtgaccttttgcagga

SEQ ID NO: 14014 - DNA, 23 bp, Artificial Sequence
  Synthetic construct
ccctgggtgaccttttgcaggac

SEQ ID NO: 14015 - DNA, 23 bp, Artificial Sequence
  Synthetic construct
cctgggtgaccttttgcaggact

SEQ ID NO: 14016 - DNA, 23 bp, Artificial Sequence
  Synthetic construct
ctgggtgaccttttgcaggactt

SEQ ID NO: 14017 - DNA, 23 bp, Artificial Sequence
  Synthetic construct
tgggtgaccttttgcaggacttc

SEQ ID NO: 14018 - DNA, 23 bp, Artificial Sequence
  Synthetic construct
gggtgaccttttgcaggacttcg

SEQ ID NO: 14019 - DNA, 23 bp, Artificial Sequence
  Synthetic construct
ggtgaccttttgcaggacttcgg

SEQ ID NO: 14020 - DNA, 23 bp, Artificial Sequence
  Synthetic construct
gtgaccttttgcaggacttcggt

SEQ ID NO: 14021 - DNA, 23 bp, Artificial Sequence
  Synthetic construct
tgaccttttgcaggacttcggtc

SEQ ID NO: 14022 - DNA, 23 bp, Artificial Sequence
  Synthetic construct
gaccttttgcaggacttcggtcg

SEQ ID NO: 14023 - DNA, 23 bp, Artificial Sequence
  Synthetic construct
accttttgcaggacttcggtcga

SEQ ID NO: 14024 - DNA, 23 bp, Artificial Sequence
  Synthetic construct
ccttttgcaggacttcggtcgac

SEQ ID NO: 14025 - DNA, 23 bp, Artificial Sequence
  Synthetic construct
cttttgcaggacttcggtcgacg

SEQ ID NO: 14026 - DNA, 23 bp, Artificial Sequence
  Synthetic construct
ttttgcaggacttcggtcgacgc

SEQ ID NO: 14027 - DNA, 23 bp, Artificial Sequence
  Synthetic construct
tttgcaggacttcggtcgacgcc

SEQ ID NO: 14028 - DNA, 23 bp, Artificial Sequence
  Synthetic construct
ttgcaggacttcggtcgacgccc

SEQ ID NO: 14029 - DNA, 23 bp, Artificial Sequence
  Synthetic construct
tgcaggacttcggtcgacgcccg

SEQ ID NO: 14030 - DNA, 23 bp, Artificial Sequence
  Synthetic construct
gcaggacttcggtcgacgcccgg

SEQ ID NO: 14031 - DNA, 23 bp, Artificial Sequence
  Synthetic construct
caggacttcggtcgacgcccggt

SEQ ID NO: 14032 - DNA, 23 bp, Artificial Sequence
  Synthetic construct
aggacttcggtcgacgcccggtt

SEQ ID NO: 14033 - DNA, 23 bp, Artificial Sequence
  Synthetic construct
ggacttcggtcgacgcccggttc

SEQ ID NO: 14034 - DNA, 23 bp, Artificial Sequence
  Synthetic construct
gacttcggtcgacgcccggttcg

SEQ ID NO: 14035 - DNA, 23 bp, Artificial Sequence
  Synthetic construct
acttcggtcgacgcccggttcgc

SEQ ID NO: 14036 - DNA, 23 bp, Artificial Sequence
  Synthetic construct
cttcggtcgacgcccggttcgca

SEQ ID NO: 14037 - DNA, 23 bp, Artificial Sequence
  Synthetic construct
ttcggtcgacgcccggttcgcaa

SEQ ID NO: 14038 - DNA, 23 bp, Artificial Sequence
  Synthetic construct
tcggtcgacgcccggttcgcaac

SEQ ID NO: 14039 - DNA, 23 bp, Artificial Sequence
  Synthetic construct
cggtcgacgcccggttcgcaacg

SEQ ID NO: 14040 - DNA, 23 bp, Artificial Sequence
  Synthetic construct
ggtcgacgcccggttcgcaacgt

SEQ ID NO: 14041 - DNA, 23 bp, Artificial Sequence
  Synthetic construct
gtcgacgcccggttcgcaacgtt

SEQ ID NO: 14042 - DNA, 23 bp, Artificial Sequence
  Synthetic construct
tcgacgcccggttcgcaacgttc

SEQ ID NO: 14043 - DNA, 23 bp, Artificial Sequence
  Synthetic construct
cgacgcccggttcgcaacgttct

SEQ ID NO: 14044 - DNA, 23 bp, Artificial Sequence
  Synthetic construct
gacgcccggttcgcaacgttctg

SEQ ID NO: 14045 - DNA, 23 bp, Artificial Sequence
  Synthetic construct
acgcccggttcgcaacgttctgc

SEQ ID NO: 14046 - DNA, 23 bp, Artificial Sequence
  Synthetic construct
cgcccggttcgcaacgttctgcg

SEQ ID NO: 14047 - DNA, 23 bp, Artificial Sequence
  Synthetic construct
gcccggttcgcaacgttctgcgg

SEQ ID NO: 14048 - DNA, 23 bp, Artificial Sequence
  Synthetic construct
cccggttcgcaacgttctgcggc

SEQ ID NO: 14049 - DNA, 23 bp, Artificial Sequence
  Synthetic construct
ccggttcgcaacgttctgcggca

SEQ ID NO: 14050 - DNA, 23 bp, Artificial Sequence
  Synthetic construct
cggttcgcaacgttctgcggcac

SEQ ID NO: 14051 - DNA, 23 bp, Artificial Sequence
  Synthetic construct
ggttcgcaacgttctgcggcact

SEQ ID NO: 14052 - DNA, 23 bp, Artificial Sequence
  Synthetic construct
gttcgcaacgttctgcggcactt

SEQ ID NO: 14053 - DNA, 23 bp, Artificial Sequence
  Synthetic construct
ttcgcaacgttctgcggcacttc

SEQ ID NO: 14054 - DNA, 23 bp, Artificial Sequence
  Synthetic construct
tcgcaacgttctgcggcacttcg

SEQ ID NO: 14055 - DNA, 23 bp, Artificial Sequence
  Synthetic construct
cgcaacgttctgcggcacttcga

SEQ ID NO: 14056 - DNA, 23 bp, Artificial Sequence
  Synthetic construct
gcaacgttctgcggcacttcgat

SEQ ID NO: 14057 - DNA, 23 bp, Artificial Sequence
  Synthetic construct
caacgttctgcggcacttcgatg

SEQ ID NO: 14058 - DNA, 23 bp, Artificial Sequence
  Synthetic construct
aacgttctgcggcacttcgatgt

SEQ ID NO: 14059 - DNA, 23 bp, Artificial Sequence
  Synthetic construct
acgttctgcggcacttcgatgta

SEQ ID NO: 14060 - DNA, 23 bp, Artificial Sequence
  Synthetic construct
cgttctgcggcacttcgatgtaa

SEQ ID NO: 14061 - DNA, 23 bp, Artificial Sequence
  Synthetic construct
gttctgcggcacttcgatgtaag

SEQ ID NO: 14062 - DNA, 23 bp, Artificial Sequence
  Synthetic construct
ttctgcggcacttcgatgtaagt

SEQ ID NO: 14063 - DNA, 23 bp, Artificial Sequence
  Synthetic construct
tctgcggcacttcgatgtaagtc

SEQ ID NO: 14064 - DNA, 23 bp, Artificial Sequence
  Synthetic construct
ctgcggcacttcgatgtaagtca

SEQ ID NO: 14065 - DNA, 23 bp, Artificial Sequence
  Synthetic construct
tgcggcacttcgatgtaagtcaa

SEQ ID NO: 14066 - DNA, 23 bp, Artificial Sequence
  Synthetic construct
gcggcacttcgatgtaagtcaag

SEQ ID NO: 14067 - DNA, 23 bp, Artificial Sequence
  Synthetic construct
cggcacttcgatgtaagtcaagt

SEQ ID NO: 14068 - DNA, 23 bp, Artificial Sequence
  Synthetic construct
ggcacttcgatgtaagtcaagtt

SEQ ID NO: 14069 - DNA, 23 bp, Artificial Sequence
  Synthetic construct
gcacttcgatgtaagtcaagttt

SEQ ID NO: 14070 - DNA, 23 bp, Artificial Sequence
  Synthetic construct
cacttcgatgtaagtcaagtttt

SEQ ID NO: 14071 - DNA, 23 bp, Artificial Sequence
  Synthetic construct
acttcgatgtaagtcaagttttg

SEQ ID NO: 14072 - DNA, 23 bp, Artificial Sequence
  Synthetic construct
cttcgatgtaagtcaagttttgg

SEQ ID NO: 14073 - DNA, 23 bp, Artificial Sequence
  Synthetic construct
ttcgatgtaagtcaagttttggc

SEQ ID NO: 14074 - DNA, 23 bp, Artificial Sequence
  Synthetic construct
tcgatgtaagtcaagttttggct

SEQ ID NO: 14075 - DNA, 23 bp, Artificial Sequence
  Synthetic construct
cgatgtaagtcaagttttggctt

SEQ ID NO: 14076 - DNA, 23 bp, Artificial Sequence
  Synthetic construct
gatgtaagtcaagttttggctta

SEQ ID NO: 14077 - DNA, 23 bp, Artificial Sequence
  Synthetic construct
atgtaagtcaagttttggcttac

SEQ ID NO: 14078 - DNA, 23 bp, Artificial Sequence
  Synthetic construct
tgtaagtcaagttttggcttaca

SEQ ID NO: 14079 - DNA, 23 bp, Artificial Sequence
  Synthetic construct
gtaagtcaagttttggcttacag

SEQ ID NO: 14080 - DNA, 23 bp, Artificial Sequence
  Synthetic construct
taagtcaagttttggcttacagg

SEQ ID NO: 14081 - DNA, 23 bp, Artificial Sequence
  Synthetic construct
aagtcaagttttggcttacaggg

SEQ ID NO: 14082 - DNA, 23 bp, Artificial Sequence
  Synthetic construct
agtcaagttttggcttacaggga

SEQ ID NO: 14083 - DNA, 23 bp, Artificial Sequence
  Synthetic construct
gtcaagttttggcttacagggaa

SEQ ID NO: 14084 - DNA, 23 bp, Artificial Sequence
  Synthetic construct
tcaagttttggcttacagggaag

SEQ ID NO: 14085 - DNA, 23 bp, Artificial Sequence
  Synthetic construct
caagttttggcttacagggaaga

SEQ ID NO: 14086 - DNA, 23 bp, Artificial Sequence
  Synthetic construct
aagttttggcttacagggaagag

SEQ ID NO: 14087 - DNA, 23 bp, Artificial Sequence
  Synthetic construct
agttttggcttacagggaagagg

SEQ ID NO: 14088 - DNA, 23 bp, Artificial Sequence
  Synthetic construct
gttttggcttacagggaagaggc

SEQ ID NO: 14089 - DNA, 23 bp, Artificial Sequence
  Synthetic construct
ttttggcttacagggaagaggct

SEQ ID NO: 14090 - DNA, 23 bp, Artificial Sequence
  Synthetic construct
tttggcttacagggaagaggctg

SEQ ID NO: 14091 - DNA, 23 bp, Artificial Sequence
  Synthetic construct
ttggcttacagggaagaggctgt

SEQ ID NO: 14092 - DNA, 23 bp, Artificial Sequence
  Synthetic construct
tggcttacagggaagaggctgta

SEQ ID NO: 14093 - DNA, 23 bp, Artificial Sequence
  Synthetic construct
ggcttacagggaagaggctgtag

SEQ ID NO: 14094 - DNA, 23 bp, Artificial Sequence
  Synthetic construct
gcttacagggaagaggctgtagc

SEQ ID NO: 14095 - DNA, 23 bp, Artificial Sequence
  Synthetic construct
cttacagggaagaggctgtagca

SEQ ID NO: 14096 - DNA, 23 bp, Artificial Sequence
  Synthetic construct
ttacagggaagaggctgtagcag

SEQ ID NO: 14097 - DNA, 23 bp, Artificial Sequence
  Synthetic construct
tacagggaagaggctgtagcagg

SEQ ID NO: 14098 - DNA, 23 bp, Artificial Sequence
  Synthetic construct
acagggaagaggctgtagcagga

SEQ ID NO: 14099 - DNA, 23 bp, Artificial Sequence
  Synthetic construct
cagggaagaggctgtagcaggag

SEQ ID NO: 14100 - DNA, 23 bp, Artificial Sequence
  Synthetic construct
agggaagaggctgtagcaggagc

SEQ ID NO: 14101 - DNA, 23 bp, Artificial Sequence
  Synthetic construct
gggaagaggctgtagcaggagcg

SEQ ID NO: 14102 - DNA, 23 bp, Artificial Sequence
  Synthetic construct
ggaagaggctgtagcaggagcgt

SEQ ID NO: 14103 - DNA, 23 bp, Artificial Sequence
  Synthetic construct
gaagaggctgtagcaggagcgtg

SEQ ID NO: 14104 - DNA, 23 bp, Artificial Sequence
  Synthetic construct
aagaggctgtagcaggagcgtgc

SEQ ID NO: 14105 - DNA, 23 bp, Artificial Sequence
  Synthetic construct
agaggctgtagcaggagcgtgcg

SEQ ID NO: 14106 - DNA, 23 bp, Artificial Sequence
  Synthetic construct
gaggctgtagcaggagcgtgcgt

SEQ ID NO: 14107 - DNA, 23 bp, Artificial Sequence
  Synthetic construct
aggctgtagcaggagcgtgcgtc

SEQ ID NO: 14108 - DNA, 23 bp, Artificial Sequence
  Synthetic construct
ggctgtagcaggagcgtgcgtcg

SEQ ID NO: 14109 - DNA, 23 bp, Artificial Sequence
  Synthetic construct
gctgtagcaggagcgtgcgtcga

SEQ ID NO: 14110 - DNA, 23 bp, Artificial Sequence
  Synthetic construct
ctgtagcaggagcgtgcgtcgag

SEQ ID NO: 14111 - DNA, 23 bp, Artificial Sequence
  Synthetic construct
tgtagcaggagcgtgcgtcgagg

SEQ ID NO: 14112 - DNA, 23 bp, Artificial Sequence
  Synthetic construct
gtagcaggagcgtgcgtcgaggg

SEQ ID NO: 14113 - DNA, 23 bp, Artificial Sequence
  Synthetic construct
tagcaggagcgtgcgtcgaggga

SEQ ID NO: 14114 - DNA, 23 bp, Artificial Sequence
  Synthetic construct
agcaggagcgtgcgtcgagggag

SEQ ID NO: 14115 - DNA, 23 bp, Artificial Sequence
  Synthetic construct
gcaggagcgtgcgtcgagggaga

SEQ ID NO: 14116 - DNA, 23 bp, Artificial Sequence
  Synthetic construct
caggagcgtgcgtcgagggagaa

SEQ ID NO: 14117 - DNA, 23 bp, Artificial Sequence
  Synthetic construct
aggagcgtgcgtcgagggagaag

SEQ ID NO: 14118 - DNA, 23 bp, Artificial Sequence
  Synthetic construct
ggagcgtgcgtcgagggagaagc

SEQ ID NO: 14119 - DNA, 23 bp, Artificial Sequence
  Synthetic construct
gagcgtgcgtcgagggagaagcc

SEQ ID NO: 14120 - DNA, 23 bp, Artificial Sequence
  Synthetic construct
agcgtgcgtcgagggagaagccg

SEQ ID NO: 14121 - DNA, 23 bp, Artificial Sequence
  Synthetic construct
gcgtgcgtcgagggagaagccga

SEQ ID NO: 14122 - DNA, 23 bp, Artificial Sequence
  Synthetic construct
cgtgcgtcgagggagaagccgaa

SEQ ID NO: 14123 - DNA, 23 bp, Artificial Sequence
  Synthetic construct
gtgcgtcgagggagaagccgaaa

SEQ ID NO: 14124 - DNA, 23 bp, Artificial Sequence
  Synthetic construct
tgcgtcgagggagaagccgaaac

SEQ ID NO: 14125 - DNA, 23 bp, Artificial Sequence
  Synthetic construct
gcgtcgagggagaagccgaaacc

SEQ ID NO: 14126 - DNA, 23 bp, Artificial Sequence
  Synthetic construct
cgtcgagggagaagccgaaaccg

SEQ ID NO: 14127 - DNA, 23 bp, Artificial Sequence
  Synthetic construct
gtcgagggagaagccgaaaccgg

SEQ ID NO: 14128 - DNA, 23 bp, Artificial Sequence
  Synthetic construct
tcgagggagaagccgaaaccggc

SEQ ID NO: 14129 - DNA, 23 bp, Artificial Sequence
  Synthetic construct
cgagggagaagccgaaaccggct

SEQ ID NO: 14130 - DNA, 23 bp, Artificial Sequence
  Synthetic construct
gagggagaagccgaaaccggctt

SEQ ID NO: 14131 - DNA, 23 bp, Artificial Sequence
  Synthetic construct
agggagaagccgaaaccggcttt

SEQ ID NO: 14132 - DNA, 23 bp, Artificial Sequence
  Synthetic construct
gggagaagccgaaaccggctttc

SEQ ID NO: 14133 - DNA, 23 bp, Artificial Sequence
  Synthetic construct
ggagaagccgaaaccggctttct

SEQ ID NO: 14134 - DNA, 23 bp, Artificial Sequence
  Synthetic construct
gagaagccgaaaccggctttctc

SEQ ID NO: 14135 - DNA, 23 bp, Artificial Sequence
  Synthetic construct
agaagccgaaaccggctttctcc

SEQ ID NO: 14136 - DNA, 23 bp, Artificial Sequence
  Synthetic construct
gaagccgaaaccggctttctcct

SEQ ID NO: 14137 - DNA, 23 bp, Artificial Sequence
  Synthetic construct
aagccgaaaccggctttctcctc

SEQ ID NO: 14138 - DNA, 23 bp, Artificial Sequence
  Synthetic construct
agccgaaaccggctttctcctcg

SEQ ID NO: 14139 - DNA, 23 bp, Artificial Sequence
  Synthetic construct
gccgaaaccggctttctcctcgt

SEQ ID NO: 14140 - DNA, 23 bp, Artificial Sequence
  Synthetic construct
ccgaaaccggctttctcctcgta

SEQ ID NO: 14141 - DNA, 23 bp, Artificial Sequence
  Synthetic construct
cgaaaccggctttctcctcgtac

SEQ ID NO: 14142 - DNA, 23 bp, Artificial Sequence
  Synthetic construct
gaaaccggctttctcctcgtacg

SEQ ID NO: 14143 - DNA, 23 bp, Artificial Sequence
  Synthetic construct
aaaccggctttctcctcgtacgg

SEQ ID NO: 14144 - DNA, 23 bp, Artificial Sequence
  Synthetic construct
aaccggctttctcctcgtacggg

SEQ ID NO: 14145 - DNA, 23 bp, Artificial Sequence
  Synthetic construct
accggctttctcctcgtacgggc

SEQ ID NO: 14146 - DNA, 23 bp, Artificial Sequence
  Synthetic construct
ccggctttctcctcgtacgggcg

SEQ ID NO: 14147 - DNA, 23 bp, Artificial Sequence
  Synthetic construct
cggctttctcctcgtacgggcga

SEQ ID NO: 14148 - DNA, 23 bp, Artificial Sequence
  Synthetic construct
ggctttctcctcgtacgggcgac

SEQ ID NO: 14149 - DNA, 23 bp, Artificial Sequence
  Synthetic construct
gctttctcctcgtacgggcgacc

SEQ ID NO: 14150 - DNA, 23 bp, Artificial Sequence
  Synthetic construct
ctttctcctcgtacgggcgaccc

SEQ ID NO: 14151 - DNA, 23 bp, Artificial Sequence
  Synthetic construct
tttctcctcgtacgggcgacccc

SEQ ID NO: 14152 - DNA, 23 bp, Artificial Sequence
  Synthetic construct
ttctcctcgtacgggcgacccca

SEQ ID NO: 14153 - DNA, 23 bp, Artificial Sequence
  Synthetic construct
tctcctcgtacgggcgaccccac

SEQ ID NO: 14154 - DNA, 23 bp, Artificial Sequence
  Synthetic construct
ctcctcgtacgggcgaccccacg

SEQ ID NO: 14155 - DNA, 23 bp, Artificial Sequence
  Synthetic construct
tcctcgtacgggcgaccccacga

SEQ ID NO: 14156 - DNA, 23 bp, Artificial Sequence
  Synthetic construct
cctcgtacgggcgaccccacgat

SEQ ID NO: 14157 - DNA, 23 bp, Artificial Sequence
  Synthetic construct
ctcgtacgggcgaccccacgatg

SEQ ID NO: 14158 - DNA, 23 bp, Artificial Sequence
  Synthetic construct
tcgtacgggcgaccccacgatga

SEQ ID NO: 14159 - DNA, 23 bp, Artificial Sequence
  Synthetic construct
cgtacgggcgaccccacgatgac

SEQ ID NO: 14160 - DNA, 23 bp, Artificial Sequence
  Synthetic construct
gtacgggcgaccccacgatgacc

SEQ ID NO: 14161 - DNA, 23 bp, Artificial Sequence
  Synthetic construct
tacgggcgaccccacgatgaccc

SEQ ID NO: 14162 - DNA, 23 bp, Artificial Sequence
  Synthetic construct
acgggcgaccccacgatgaccca

SEQ ID NO: 14163 - DNA, 23 bp, Artificial Sequence
  Synthetic construct
cgggcgaccccacgatgacccac

SEQ ID NO: 14164 - DNA, 23 bp, Artificial Sequence
  Synthetic construct
gggcgaccccacgatgacccact

SEQ ID NO: 14165 - DNA, 23 bp, Artificial Sequence
  Synthetic construct
ggcgaccccacgatgacccactt

SEQ ID NO: 14166 - DNA, 23 bp, Artificial Sequence
  Synthetic construct
gcgaccccacgatgacccacttc

SEQ ID NO: 14167 - DNA, 23 bp, Artificial Sequence
  Synthetic construct
cgaccccacgatgacccacttcg

SEQ ID NO: 14168 - DNA, 23 bp, Artificial Sequence
  Synthetic construct
gaccccacgatgacccacttcgc

SEQ ID NO: 14169 - DNA, 23 bp, Artificial Sequence
  Synthetic construct
accccacgatgacccacttcgct

SEQ ID NO: 14170 - DNA, 23 bp, Artificial Sequence
  Synthetic construct
ccccacgatgacccacttcgctt

SEQ ID NO: 14171 - DNA, 23 bp, Artificial Sequence
  Synthetic construct
cccacgatgacccacttcgcttg

SEQ ID NO: 14172 - DNA, 23 bp, Artificial Sequence
  Synthetic construct
ccacgatgacccacttcgcttgt

SEQ ID NO: 14173 - DNA, 23 bp, Artificial Sequence
  Synthetic construct
cacgatgacccacttcgcttgta

SEQ ID NO: 14174 - DNA, 23 bp, Artificial Sequence
  Synthetic construct
acgatgacccacttcgcttgtag

SEQ ID NO: 14175 - DNA, 23 bp, Artificial Sequence
  Synthetic construct
cgatgacccacttcgcttgtagg

SEQ ID NO: 14176 - DNA, 23 bp, Artificial Sequence
  Synthetic construct
gatgacccacttcgcttgtaggc

SEQ ID NO: 14177 - DNA, 23 bp, Artificial Sequence
  Synthetic construct
atgacccacttcgcttgtaggca

SEQ ID NO: 14178 - DNA, 23 bp, Artificial Sequence
  Synthetic construct
tgacccacttcgcttgtaggcac

SEQ ID NO: 14179 - DNA, 23 bp, Artificial Sequence
  Synthetic construct
gacccacttcgcttgtaggcacc

SEQ ID NO: 14180 - DNA, 23 bp, Artificial Sequence
  Synthetic construct
acccacttcgcttgtaggcacct

SEQ ID NO: 14181 - DNA, 23 bp, Artificial Sequence
  Synthetic construct
cccacttcgcttgtaggcacctt

SEQ ID NO: 14182 - DNA, 23 bp, Artificial Sequence
  Synthetic construct
ccacttcgcttgtaggcaccttg

SEQ ID NO: 14183 - DNA, 23 bp, Artificial Sequence
  Synthetic construct
cacttcgcttgtaggcaccttga

SEQ ID NO: 14184 - DNA, 23 bp, Artificial Sequence
  Synthetic construct
acttcgcttgtaggcaccttgat

SEQ ID NO: 14185 - DNA, 23 bp, Artificial Sequence
  Synthetic construct
cttcgcttgtaggcaccttgatc

SEQ ID NO: 14186 - DNA, 23 bp, Artificial Sequence
  Synthetic construct
ttcgcttgtaggcaccttgatct

SEQ ID NO: 14187 - DNA, 23 bp, Artificial Sequence
  Synthetic construct
tcgcttgtaggcaccttgatcta

SEQ ID NO: 14188 - DNA, 23 bp, Artificial Sequence
  Synthetic construct
cgcttgtaggcaccttgatctat

SEQ ID NO: 14189 - DNA, 23 bp, Artificial Sequence
  Synthetic construct
gcttgtaggcaccttgatctatc

SEQ ID NO: 14190 - DNA, 23 bp, Artificial Sequence
  Synthetic construct
cttgtaggcaccttgatctatcg

SEQ ID NO: 14191 - DNA, 23 bp, Artificial Sequence
  Synthetic construct
ttgtaggcaccttgatctatcga

SEQ ID NO: 14192 - DNA, 23 bp, Artificial Sequence
  Synthetic construct
tgtaggcaccttgatctatcgat

SEQ ID NO: 14193 - DNA, 23 bp, Artificial Sequence
  Synthetic construct
gtaggcaccttgatctatcgatg

SEQ ID NO: 14194 - DNA, 23 bp, Artificial Sequence
  Synthetic construct
taggcaccttgatctatcgatgt

SEQ ID NO: 14195 - DNA, 23 bp, Artificial Sequence
  Synthetic construct
aggcaccttgatctatcgatgtg

SEQ ID NO: 14196 - DNA, 23 bp, Artificial Sequence
  Synthetic construct
ggcaccttgatctatcgatgtga

SEQ ID NO: 14197 - DNA, 23 bp, Artificial Sequence
  Synthetic construct
gcaccttgatctatcgatgtgac

SEQ ID NO: 14198 - DNA, 23 bp, Artificial Sequence
  Synthetic construct
caccttgatctatcgatgtgaca

SEQ ID NO: 14199 - DNA, 23 bp, Artificial Sequence
  Synthetic construct
accttgatctatcgatgtgacac

SEQ ID NO: 14200 - DNA, 23 bp, Artificial Sequence
  Synthetic construct
ccttgatctatcgatgtgacact

SEQ ID NO: 14201 - DNA, 23 bp, Artificial Sequence
  Synthetic construct
cttgatctatcgatgtgacactt

SEQ ID NO: 14202 - DNA, 23 bp, Artificial Sequence
  Synthetic construct
ttgatctatcgatgtgacactta

SEQ ID NO: 14203 - DNA, 23 bp, Artificial Sequence
  Synthetic construct
tgatctatcgatgtgacacttaa

SEQ ID NO: 14204 - DNA, 23 bp, Artificial Sequence
  Synthetic construct
gatctatcgatgtgacacttaac

SEQ ID NO: 14205 - DNA, 23 bp, Artificial Sequence
  Synthetic construct
atctatcgatgtgacacttaacg

SEQ ID NO: 14206 - DNA, 23 bp, Artificial Sequence
  Synthetic construct
tctatcgatgtgacacttaacgc

SEQ ID NO: 14207 - DNA, 23 bp, Artificial Sequence
  Synthetic construct
ctatcgatgtgacacttaacgcc

SEQ ID NO: 14208 - DNA, 23 bp, Artificial Sequence
  Synthetic construct
tatcgatgtgacacttaacgccc

SEQ ID NO: 14209 - DNA, 23 bp, Artificial Sequence
  Synthetic construct
atcgatgtgacacttaacgcccc

SEQ ID NO: 14210 - DNA, 23 bp, Artificial Sequence
  Synthetic construct
tcgatgtgacacttaacgccccc

SEQ ID NO: 14211 - DNA, 23 bp, Artificial Sequence
  Synthetic construct
cgatgtgacacttaacgcccccc

SEQ ID NO: 14212 - DNA, 23 bp, Artificial Sequence
  Synthetic construct
gatgtgacacttaacgccccccg

SEQ ID NO: 14213 - DNA, 23 bp, Artificial Sequence
  Synthetic construct
atgtgacacttaacgccccccgt

SEQ ID NO: 14214 - DNA, 23 bp, Artificial Sequence
  Synthetic construct
tgtgacacttaacgccccccgtg

SEQ ID NO: 14215 - DNA, 23 bp, Artificial Sequence
  Synthetic construct
gtgacacttaacgccccccgtga

SEQ ID NO: 14216 - DNA, 23 bp, Artificial Sequence
  Synthetic construct
tgacacttaacgccccccgtgaa

SEQ ID NO: 14217 - DNA, 23 bp, Artificial Sequence
  Synthetic construct
gacacttaacgccccccgtgaat

SEQ ID NO: 14218 - DNA, 23 bp, Artificial Sequence
  Synthetic construct
acacttaacgccccccgtgaata

SEQ ID NO: 14219 - DNA, 23 bp, Artificial Sequence
  Synthetic construct
cacttaacgccccccgtgaatac

SEQ ID NO: 14220 - DNA, 23 bp, Artificial Sequence
  Synthetic construct
acttaacgccccccgtgaatacg

SEQ ID NO: 14221 - DNA, 23 bp, Artificial Sequence
  Synthetic construct
cttaacgccccccgtgaatacgg

SEQ ID NO: 14222 - DNA, 23 bp, Artificial Sequence
  Synthetic construct
ttaacgccccccgtgaatacgga

SEQ ID NO: 14223 - DNA, 23 bp, Artificial Sequence
  Synthetic construct
taacgccccccgtgaatacggag

SEQ ID NO: 14224 - DNA, 23 bp, Artificial Sequence
  Synthetic construct
aacgccccccgtgaatacggaga

SEQ ID NO: 14225 - DNA, 23 bp, Artificial Sequence
  Synthetic construct
acgccccccgtgaatacggagag

SEQ ID NO: 14226 - DNA, 23 bp, Artificial Sequence
  Synthetic construct
cgccccccgtgaatacggagagg

SEQ ID NO: 14227 - DNA, 23 bp, Artificial Sequence
  Synthetic construct
gccccccgtgaatacggagaggg

SEQ ID NO: 14228 - DNA, 23 bp, Artificial Sequence
  Synthetic construct
ccccccgtgaatacggagagggg

SEQ ID NO: 14229 - DNA, 23 bp, Artificial Sequence
  Synthetic construct
cccccgtgaatacggagaggggt

SEQ ID NO: 14230 - DNA, 23 bp, Artificial Sequence
  Synthetic construct
ccccgtgaatacggagaggggta

SEQ ID NO: 14231 - DNA, 23 bp, Artificial Sequence
  Synthetic construct
cccgtgaatacggagaggggtag

SEQ ID NO: 14232 - DNA, 23 bp, Artificial Sequence
  Synthetic construct
ccgtgaatacggagaggggtagt

SEQ ID NO: 14233 - DNA, 23 bp, Artificial Sequence
  Synthetic construct
cgtgaatacggagaggggtagtg

SEQ ID NO: 14234 - DNA, 23 bp, Artificial Sequence
  Synthetic construct
gtgaatacggagaggggtagtgc

SEQ ID NO: 14235 - DNA, 23 bp, Artificial Sequence
  Synthetic construct
tgaatacggagaggggtagtgcc

SEQ ID NO: 14236 - DNA, 23 bp, Artificial Sequence
  Synthetic construct
gaatacggagaggggtagtgcca

SEQ ID NO: 14237 - DNA, 23 bp, Artificial Sequence
  Synthetic construct
aatacggagaggggtagtgccac

SEQ ID NO: 14238 - DNA, 23 bp, Artificial Sequence
  Synthetic construct
atacggagaggggtagtgccact

SEQ ID NO: 14239 - DNA, 23 bp, Artificial Sequence
  Synthetic construct
tacggagaggggtagtgccactg

SEQ ID NO: 14240 - DNA, 23 bp, Artificial Sequence
  Synthetic construct
acggagaggggtagtgccactgt

SEQ ID NO: 14241 - DNA, 23 bp, Artificial Sequence
  Synthetic construct
cggagaggggtagtgccactgtt

SEQ ID NO: 14242 - DNA, 23 bp, Artificial Sequence
  Synthetic construct
ggagaggggtagtgccactgttt

SEQ ID NO: 14243 - DNA, 23 bp, Artificial Sequence
  Synthetic construct
gagaggggtagtgccactgtttc

SEQ ID NO: 14244 - DNA, 23 bp, Artificial Sequence
  Synthetic construct
agaggggtagtgccactgtttcg

SEQ ID NO: 14245 - DNA, 23 bp, Artificial Sequence
  Synthetic construct
gaggggtagtgccactgtttcgt

SEQ ID NO: 14246 - DNA, 23 bp, Artificial Sequence
  Synthetic construct
aggggtagtgccactgtttcgtt

SEQ ID NO: 14247 - DNA, 23 bp, Artificial Sequence
  Synthetic construct
ggggtagtgccactgtttcgttt

SEQ ID NO: 14248 - DNA, 23 bp, Artificial Sequence
  Synthetic construct
gggtagtgccactgtttcgtttt

SEQ ID NO: 14249 - DNA, 23 bp, Artificial Sequence
  Synthetic construct
ggtagtgccactgtttcgttttg

SEQ ID NO: 14250 - DNA, 23 bp, Artificial Sequence
  Synthetic construct
gtagtgccactgtttcgttttgg

SEQ ID NO: 14251 - DNA, 23 bp, Artificial Sequence
  Synthetic construct
tagtgccactgtttcgttttggc

SEQ ID NO: 14252 - DNA, 23 bp, Artificial Sequence
  Synthetic construct
agtgccactgtttcgttttggcc

SEQ ID NO: 14253 - DNA, 23 bp, Artificial Sequence
  Synthetic construct
gtgccactgtttcgttttggccc

SEQ ID NO: 14254 - DNA, 23 bp, Artificial Sequence
  Synthetic construct
tgccactgtttcgttttggcccc

SEQ ID NO: 14255 - DNA, 23 bp, Artificial Sequence
  Synthetic construct
gccactgtttcgttttggcccca

SEQ ID NO: 14256 - DNA, 23 bp, Artificial Sequence
  Synthetic construct
ccactgtttcgttttggccccag

SEQ ID NO: 14257 - DNA, 23 bp, Artificial Sequence
  Synthetic construct
cactgtttcgttttggccccagt

SEQ ID NO: 14258 - DNA, 23 bp, Artificial Sequence
  Synthetic construct
actgtttcgttttggccccagtc

SEQ ID NO: 14259 - DNA, 23 bp, Artificial Sequence
  Synthetic construct
ctgtttcgttttggccccagtcg

SEQ ID NO: 14260 - DNA, 23 bp, Artificial Sequence
  Synthetic construct
tgtttcgttttggccccagtcga

SEQ ID NO: 14261 - DNA, 23 bp, Artificial Sequence
  Synthetic construct
gtttcgttttggccccagtcgag

SEQ ID NO: 14262 - DNA, 23 bp, Artificial Sequence
  Synthetic construct
tttcgttttggccccagtcgagt

SEQ ID NO: 14263 - DNA, 23 bp, Artificial Sequence
  Synthetic construct
ttcgttttggccccagtcgagtt

SEQ ID NO: 14264 - DNA, 23 bp, Artificial Sequence
  Synthetic construct
tcgttttggccccagtcgagtta

SEQ ID NO: 14265 - DNA, 23 bp, Artificial Sequence
  Synthetic construct
cgttttggccccagtcgagttaa

SEQ ID NO: 14266 - DNA, 23 bp, Artificial Sequence
  Synthetic construct
gttttggccccagtcgagttaaa

SEQ ID NO: 14267 - DNA, 23 bp, Artificial Sequence
  Synthetic construct
ttttggccccagtcgagttaaaa

SEQ ID NO: 14268 - DNA, 23 bp, Artificial Sequence
  Synthetic construct
tttggccccagtcgagttaaaac

SEQ ID NO: 14269 - DNA, 23 bp, Artificial Sequence
  Synthetic construct
ttggccccagtcgagttaaaacg

SEQ ID NO: 14270 - DNA, 23 bp, Artificial Sequence
  Synthetic construct
tggccccagtcgagttaaaacga

SEQ ID NO: 14271 - DNA, 23 bp, Artificial Sequence
  Synthetic construct
ggccccagtcgagttaaaacgac

SEQ ID NO: 14272 - DNA, 23 bp, Artificial Sequence
  Synthetic construct
gccccagtcgagttaaaacgacc

SEQ ID NO: 14273 - DNA, 23 bp, Artificial Sequence
  Synthetic construct
ccccagtcgagttaaaacgaccg

SEQ ID NO: 14274 - DNA, 23 bp, Artificial Sequence
  Synthetic construct
cccagtcgagttaaaacgaccgg

SEQ ID NO: 14275 - DNA, 23 bp, Artificial Sequence
  Synthetic construct
ccagtcgagttaaaacgaccggg

SEQ ID NO: 14276 - DNA, 23 bp, Artificial Sequence
  Synthetic construct
cagtcgagttaaaacgaccggga

SEQ ID NO: 14277 - DNA, 23 bp, Artificial Sequence
  Synthetic construct
agtcgagttaaaacgaccgggag

SEQ ID NO: 14278 - DNA, 23 bp, Artificial Sequence
  Synthetic construct
gtcgagttaaaacgaccgggagt

SEQ ID NO: 14279 - DNA, 23 bp, Artificial Sequence
  Synthetic construct
tcgagttaaaacgaccgggagtc

SEQ ID NO: 14280 - DNA, 23 bp, Artificial Sequence
  Synthetic construct
cgagttaaaacgaccgggagtcc

SEQ ID NO: 14281 - DNA, 23 bp, Artificial Sequence
  Synthetic construct
gagttaaaacgaccgggagtcca

SEQ ID NO: 14282 - DNA, 23 bp, Artificial Sequence
  Synthetic construct
agttaaaacgaccgggagtccag

SEQ ID NO: 14283 - DNA, 23 bp, Artificial Sequence
  Synthetic construct
gttaaaacgaccgggagtccagt

SEQ ID NO: 14284 - DNA, 23 bp, Artificial Sequence
  Synthetic construct
ttaaaacgaccgggagtccagtt

SEQ ID NO: 14285 - DNA, 23 bp, Artificial Sequence
  Synthetic construct
taaaacgaccgggagtccagttc

SEQ ID NO: 14286 - DNA, 23 bp, Artificial Sequence
  Synthetic construct
aaaacgaccgggagtccagttcg

SEQ ID NO: 14287 - DNA, 23 bp, Artificial Sequence
  Synthetic construct
aaacgaccgggagtccagttcga

SEQ ID NO: 14288 - DNA, 23 bp, Artificial Sequence
  Synthetic construct
aacgaccgggagtccagttcgaa

SEQ ID NO: 14289 - DNA, 23 bp, Artificial Sequence
  Synthetic construct
acgaccgggagtccagttcgaac

SEQ ID NO: 14290 - DNA, 23 bp, Artificial Sequence
  Synthetic construct
cgaccgggagtccagttcgaacg

SEQ ID NO: 14291 - DNA, 23 bp, Artificial Sequence
  Synthetic construct
gaccgggagtccagttcgaacga

SEQ ID NO: 14292 - DNA, 23 bp, Artificial Sequence
  Synthetic construct
accgggagtccagttcgaacgat

SEQ ID NO: 14293 - DNA, 23 bp, Artificial Sequence
  Synthetic construct
ccgggagtccagttcgaacgata

SEQ ID NO: 14294 - DNA, 23 bp, Artificial Sequence
  Synthetic construct
cgggagtccagttcgaacgatat

SEQ ID NO: 14295 - DNA, 23 bp, Artificial Sequence
  Synthetic construct
gggagtccagttcgaacgatatt

SEQ ID NO: 14296 - DNA, 23 bp, Artificial Sequence
  Synthetic construct
ggagtccagttcgaacgatattt

SEQ ID NO: 14297 - DNA, 23 bp, Artificial Sequence
  Synthetic construct
gagtccagttcgaacgatatttt

SEQ ID NO: 14298 - DNA, 23 bp, Artificial Sequence
  Synthetic construct
agtccagttcgaacgatatttta

SEQ ID NO: 14299 - DNA, 23 bp, Artificial Sequence
  Synthetic construct
gtccagttcgaacgatattttaa

SEQ ID NO: 14300 - DNA, 23 bp, Artificial Sequence
  Synthetic construct
tccagttcgaacgatattttaaa

SEQ ID NO: 14301 - DNA, 23 bp, Artificial Sequence
  Synthetic construct
ccagttcgaacgatattttaaag

SEQ ID NO: 14302 - DNA, 23 bp, Artificial Sequence
  Synthetic construct
cagttcgaacgatattttaaaga

SEQ ID NO: 14303 - DNA, 23 bp, Artificial Sequence
  Synthetic construct
agttcgaacgatattttaaagag

SEQ ID NO: 14304 - DNA, 23 bp, Artificial Sequence
  Synthetic construct
gttcgaacgatattttaaagaga

SEQ ID NO: 14305 - DNA, 23 bp, Artificial Sequence
  Synthetic construct
ttcgaacgatattttaaagagaa

SEQ ID NO: 14306 - DNA, 23 bp, Artificial Sequence
  Synthetic construct
tcgaacgatattttaaagagaat

SEQ ID NO: 14307 - DNA, 23 bp, Artificial Sequence
  Synthetic construct
cgaacgatattttaaagagaatg

SEQ ID NO: 14308 - DNA, 23 bp, Artificial Sequence
  Synthetic construct
gaacgatattttaaagagaatga

SEQ ID NO: 14309 - DNA, 23 bp, Artificial Sequence
  Synthetic construct
aacgatattttaaagagaatgag

SEQ ID NO: 14310 - DNA, 23 bp, Artificial Sequence
  Synthetic construct
acgatattttaaagagaatgagt

SEQ ID NO: 14311 - DNA, 23 bp, Artificial Sequence
  Synthetic construct
cgatattttaaagagaatgagtt

SEQ ID NO: 14312 - DNA, 23 bp, Artificial Sequence
  Synthetic construct
gatattttaaagagaatgagtta

SEQ ID NO: 14313 - DNA, 23 bp, Artificial Sequence
  Synthetic construct
atattttaaagagaatgagttat

SEQ ID NO: 14314 - DNA, 23 bp, Artificial Sequence
  Synthetic construct
tattttaaagagaatgagttatc

SEQ ID NO: 14315 - DNA, 23 bp, Artificial Sequence
  Synthetic construct
attttaaagagaatgagttatct

SEQ ID NO: 14316 - DNA, 23 bp, Artificial Sequence
  Synthetic construct
ttttaaagagaatgagttatctt

SEQ ID NO: 14317 - DNA, 23 bp, Artificial Sequence
  Synthetic construct
tttaaagagaatgagttatcttc

SEQ ID NO: 14318 - DNA, 23 bp, Artificial Sequence
  Synthetic construct
ttaaagagaatgagttatcttca

SEQ ID NO: 14319 - DNA, 23 bp, Artificial Sequence
  Synthetic construct
taaagagaatgagttatcttcag

SEQ ID NO: 14320 - DNA, 23 bp, Artificial Sequence
  Synthetic construct
aaagagaatgagttatcttcagt

SEQ ID NO: 14321 - DNA, 23 bp, Artificial Sequence
  Synthetic construct
aagagaatgagttatcttcagtc

SEQ ID NO: 14322 - DNA, 23 bp, Artificial Sequence
  Synthetic construct
agagaatgagttatcttcagtct

SEQ ID NO: 14323 - DNA, 23 bp, Artificial Sequence
  Synthetic construct
gagaatgagttatcttcagtctc

SEQ ID NO: 14324 - DNA, 23 bp, Artificial Sequence
  Synthetic construct
agaatgagttatcttcagtctca

SEQ ID NO: 14325 - DNA, 23 bp, Artificial Sequence
  Synthetic construct
gaatgagttatcttcagtctcac

SEQ ID NO: 14326 - DNA, 23 bp, Artificial Sequence
  Synthetic construct
aatgagttatcttcagtctcacc

SEQ ID NO: 14327 - DNA, 23 bp, Artificial Sequence
  Synthetic construct
atgagttatcttcagtctcaccg

SEQ ID NO: 14328 - DNA, 23 bp, Artificial Sequence
  Synthetic construct
tgagttatcttcagtctcaccgt

SEQ ID NO: 14329 - DNA, 23 bp, Artificial Sequence
  Synthetic construct
gagttatcttcagtctcaccgtc

SEQ ID NO: 14330 - DNA, 23 bp, Artificial Sequence
  Synthetic construct
agttatcttcagtctcaccgtcc

SEQ ID NO: 14331 - DNA, 23 bp, Artificial Sequence
  Synthetic construct
gttatcttcagtctcaccgtccg

SEQ ID NO: 14332 - DNA, 23 bp, Artificial Sequence
  Synthetic construct
ttatcttcagtctcaccgtccgc

SEQ ID NO: 14333 - DNA, 23 bp, Artificial Sequence
  Synthetic construct
tatcttcagtctcaccgtccgcg

SEQ ID NO: 14334 - DNA, 23 bp, Artificial Sequence
  Synthetic construct
atcttcagtctcaccgtccgcgt

SEQ ID NO: 14335 - DNA, 23 bp, Artificial Sequence
  Synthetic construct
tcttcagtctcaccgtccgcgta

SEQ ID NO: 14336 - DNA, 23 bp, Artificial Sequence
  Synthetic construct
cttcagtctcaccgtccgcgtaa

SEQ ID NO: 14337 - DNA, 23 bp, Artificial Sequence
  Synthetic construct
ttcagtctcaccgtccgcgtaaa

SEQ ID NO: 14338 - DNA, 23 bp, Artificial Sequence
  Synthetic construct
tcagtctcaccgtccgcgtaaac

SEQ ID NO: 14339 - DNA, 23 bp, Artificial Sequence
  Synthetic construct
cagtctcaccgtccgcgtaaacg

SEQ ID NO: 14340 - DNA, 23 bp, Artificial Sequence
  Synthetic construct
agtctcaccgtccgcgtaaacgc

SEQ ID NO: 14341 - DNA, 23 bp, Artificial Sequence
  Synthetic construct
gtctcaccgtccgcgtaaacgcg

SEQ ID NO: 14342 - DNA, 23 bp, Artificial Sequence
  Synthetic construct
tctcaccgtccgcgtaaacgcga

SEQ ID NO: 14343 - DNA, 23 bp, Artificial Sequence
  Synthetic construct
ctcaccgtccgcgtaaacgcgaa

SEQ ID NO: 14344 - DNA, 23 bp, Artificial Sequence
  Synthetic construct
tcaccgtccgcgtaaacgcgaac

SEQ ID NO: 14345 - DNA, 23 bp, Artificial Sequence
  Synthetic construct
caccgtccgcgtaaacgcgaacg

SEQ ID NO: 14346 - DNA, 23 bp, Artificial Sequence
  Synthetic construct
accgtccgcgtaaacgcgaacgg

SEQ ID NO: 14347 - DNA, 23 bp, Artificial Sequence
  Synthetic construct
ccgtccgcgtaaacgcgaacgga

SEQ ID NO: 14348 - DNA, 23 bp, Artificial Sequence
  Synthetic construct
cgtccgcgtaaacgcgaacggag

SEQ ID NO: 14349 - DNA, 23 bp, Artificial Sequence
  Synthetic construct
gtccgcgtaaacgcgaacggagg

SEQ ID NO: 14350 - DNA, 23 bp, Artificial Sequence
  Synthetic construct
tccgcgtaaacgcgaacggaggg

SEQ ID NO: 14351 - DNA, 23 bp, Artificial Sequence
  Synthetic construct
ccgcgtaaacgcgaacggagggg

SEQ ID NO: 14352 - DNA, 23 bp, Artificial Sequence
  Synthetic construct
cgcgtaaacgcgaacggagggga

SEQ ID NO: 14353 - DNA, 23 bp, Artificial Sequence
  Synthetic construct
gcgtaaacgcgaacggaggggac

SEQ ID NO: 14354 - DNA, 23 bp, Artificial Sequence
  Synthetic construct
cgtaaacgcgaacggaggggacg

SEQ ID NO: 14355 - DNA, 23 bp, Artificial Sequence
  Synthetic construct
gtaaacgcgaacggaggggacga

SEQ ID NO: 14356 - DNA, 23 bp, Artificial Sequence
  Synthetic construct
taaacgcgaacggaggggacgaa

SEQ ID NO: 14357 - DNA, 23 bp, Artificial Sequence
  Synthetic construct
aaacgcgaacggaggggacgaag

SEQ ID NO: 14358 - DNA, 23 bp, Artificial Sequence
  Synthetic construct
aacgcgaacggaggggacgaagg

SEQ ID NO: 14359 - DNA, 23 bp, Artificial Sequence
  Synthetic construct
acgcgaacggaggggacgaaggt

SEQ ID NO: 14360 - DNA, 23 bp, Artificial Sequence
  Synthetic construct
cgcgaacggaggggacgaaggtc

SEQ ID NO: 14361 - DNA, 23 bp, Artificial Sequence
  Synthetic construct
gcgaacggaggggacgaaggtct

SEQ ID NO: 14362 - DNA, 23 bp, Artificial Sequence
  Synthetic construct
cgaacggaggggacgaaggtctc

SEQ ID NO: 14363 - DNA, 23 bp, Artificial Sequence
  Synthetic construct
gaacggaggggacgaaggtctcg

SEQ ID NO: 14364 - DNA, 23 bp, Artificial Sequence
  Synthetic construct
aacggaggggacgaaggtctcgt

SEQ ID NO: 14365 - DNA, 23 bp, Artificial Sequence
  Synthetic construct
acggaggggacgaaggtctcgtt

SEQ ID NO: 14366 - DNA, 23 bp, Artificial Sequence
  Synthetic construct
cggaggggacgaaggtctcgttc

SEQ ID NO: 14367 - DNA, 23 bp, Artificial Sequence
  Synthetic construct
ggaggggacgaaggtctcgttct

SEQ ID NO: 14368 - DNA, 23 bp, Artificial Sequence
  Synthetic construct
gaggggacgaaggtctcgttctc

SEQ ID NO: 14369 - DNA, 23 bp, Artificial Sequence
  Synthetic construct
aggggacgaaggtctcgttctcc

SEQ ID NO: 14370 - DNA, 23 bp, Artificial Sequence
  Synthetic construct
ggggacgaaggtctcgttctccc

SEQ ID NO: 14371 - DNA, 23 bp, Artificial Sequence
  Synthetic construct
gggacgaaggtctcgttctccct

SEQ ID NO: 14372 - DNA, 23 bp, Artificial Sequence
  Synthetic construct
ggacgaaggtctcgttctcccta

SEQ ID NO: 14373 - DNA, 23 bp, Artificial Sequence
  Synthetic construct
gacgaaggtctcgttctccctat

SEQ ID NO: 14374 - DNA, 23 bp, Artificial Sequence
  Synthetic construct
acgaaggtctcgttctccctatc

SEQ ID NO: 14375 - DNA, 23 bp, Artificial Sequence
  Synthetic construct
cgaaggtctcgttctccctatca

SEQ ID NO: 14376 - DNA, 23 bp, Artificial Sequence
  Synthetic construct
gaaggtctcgttctccctatcaa

SEQ ID NO: 14377 - DNA, 23 bp, Artificial Sequence
  Synthetic construct
aaggtctcgttctccctatcaag

SEQ ID NO: 14378 - DNA, 23 bp, Artificial Sequence
  Synthetic construct
aggtctcgttctccctatcaagg

SEQ ID NO: 14379 - DNA, 23 bp, Artificial Sequence
  Synthetic construct
ggtctcgttctccctatcaaggg

SEQ ID NO: 14380 - DNA, 23 bp, Artificial Sequence
  Synthetic construct
gtctcgttctccctatcaagggt

SEQ ID NO: 14381 - DNA, 23 bp, Artificial Sequence
  Synthetic construct
tctcgttctccctatcaagggta

SEQ ID NO: 14382 - DNA, 23 bp, Artificial Sequence
  Synthetic construct
ctcgttctccctatcaagggtac

SEQ ID NO: 14383 - DNA, 23 bp, Artificial Sequence
  Synthetic construct
tcgttctccctatcaagggtact

SEQ ID NO: 14384 - DNA, 23 bp, Artificial Sequence
  Synthetic construct
cgttctccctatcaagggtacta

SEQ ID NO: 14385 - DNA, 23 bp, Artificial Sequence
  Synthetic construct
gttctccctatcaagggtactaa

SEQ ID NO: 14386 - DNA, 23 bp, Artificial Sequence
  Synthetic construct
ttctccctatcaagggtactaaa

SEQ ID NO: 14387 - DNA, 23 bp, Artificial Sequence
  Synthetic construct
tctccctatcaagggtactaaaa

SEQ ID NO: 14388 - DNA, 23 bp, Artificial Sequence
  Synthetic construct
ctccctatcaagggtactaaaag

SEQ ID NO: 14389 - DNA, 23 bp, Artificial Sequence
  Synthetic construct
tccctatcaagggtactaaaagc

SEQ ID NO: 14390 - DNA, 23 bp, Artificial Sequence
  Synthetic construct
ccctatcaagggtactaaaagct

SEQ ID NO: 14391 - DNA, 23 bp, Artificial Sequence
  Synthetic construct
cctatcaagggtactaaaagctc

SEQ ID NO: 14392 - DNA, 23 bp, Artificial Sequence
  Synthetic construct
ctatcaagggtactaaaagctcg

SEQ ID NO: 14393 - DNA, 23 bp, Artificial Sequence
  Synthetic construct
tatcaagggtactaaaagctcgc

SEQ ID NO: 14394 - DNA, 23 bp, Artificial Sequence
  Synthetic construct
atcaagggtactaaaagctcgca

SEQ ID NO: 14395 - DNA, 23 bp, Artificial Sequence
  Synthetic construct
tcaagggtactaaaagctcgcac

SEQ ID NO: 14396 - DNA, 23 bp, Artificial Sequence
  Synthetic construct
caagggtactaaaagctcgcaca

SEQ ID NO: 14397 - DNA, 23 bp, Artificial Sequence
  Synthetic construct
aagggtactaaaagctcgcacag

SEQ ID NO: 14398 - DNA, 23 bp, Artificial Sequence
  Synthetic construct
agggtactaaaagctcgcacagg

SEQ ID NO: 14399 - DNA, 23 bp, Artificial Sequence
  Synthetic construct
gggtactaaaagctcgcacaggt

SEQ ID NO: 14400 - DNA, 23 bp, Artificial Sequence
  Synthetic construct
ggtactaaaagctcgcacaggtc

SEQ ID NO: 14401 - DNA, 23 bp, Artificial Sequence
  Synthetic construct
gtactaaaagctcgcacaggtca

SEQ ID NO: 14402 - DNA, 23 bp, Artificial Sequence
  Synthetic construct
tactaaaagctcgcacaggtcaa

SEQ ID NO: 14403 - DNA, 23 bp, Artificial Sequence
  Synthetic construct
actaaaagctcgcacaggtcaaa

SEQ ID NO: 14404 - DNA, 23 bp, Artificial Sequence
  Synthetic construct
ctaaaagctcgcacaggtcaaac

SEQ ID NO: 14405 - DNA, 23 bp, Artificial Sequence
  Synthetic construct
taaaagctcgcacaggtcaaacc

SEQ ID NO: 14406 - DNA, 23 bp, Artificial Sequence
  Synthetic construct
aaaagctcgcacaggtcaaacct

SEQ ID NO: 14407 - DNA, 23 bp, Artificial Sequence
  Synthetic construct
aaagctcgcacaggtcaaacctc

SEQ ID NO: 14408 - DNA, 23 bp, Artificial Sequence
  Synthetic construct
aagctcgcacaggtcaaacctcc

SEQ ID NO: 14409 - DNA, 23 bp, Artificial Sequence
  Synthetic construct
agctcgcacaggtcaaacctcct

SEQ ID NO: 14410 - DNA, 23 bp, Artificial Sequence
  Synthetic construct
gctcgcacaggtcaaacctccta

SEQ ID NO: 14411 - DNA, 23 bp, Artificial Sequence
  Synthetic construct
ctcgcacaggtcaaacctcctag

SEQ ID NO: 14412 - DNA, 23 bp, Artificial Sequence
  Synthetic construct
tcgcacaggtcaaacctcctagg

SEQ ID NO: 14413 - DNA, 23 bp, Artificial Sequence
  Synthetic construct
cgcacaggtcaaacctcctagga

SEQ ID NO: 14414 - DNA, 23 bp, Artificial Sequence
  Synthetic construct
gcacaggtcaaacctcctaggaa

SEQ ID NO: 14415 - DNA, 23 bp, Artificial Sequence
  Synthetic construct
cacaggtcaaacctcctaggaat

SEQ ID NO: 14416 - DNA, 23 bp, Artificial Sequence
  Synthetic construct
acaggtcaaacctcctaggaatg

SEQ ID NO: 14417 - DNA, 23 bp, Artificial Sequence
  Synthetic construct
caggtcaaacctcctaggaatgg

SEQ ID NO: 14418 - DNA, 23 bp, Artificial Sequence
  Synthetic construct
aggtcaaacctcctaggaatgga

SEQ ID NO: 14419 - DNA, 23 bp, Artificial Sequence
  Synthetic construct
ggtcaaacctcctaggaatggaa

SEQ ID NO: 14420 - DNA, 23 bp, Artificial Sequence
  Synthetic construct
gtcaaacctcctaggaatggaat

SEQ ID NO: 14421 - DNA, 23 bp, Artificial Sequence
  Synthetic construct
tcaaacctcctaggaatggaatt

SEQ ID NO: 14422 - DNA, 23 bp, Artificial Sequence
  Synthetic construct
caaacctcctaggaatggaattc

SEQ ID NO: 14423 - DNA, 23 bp, Artificial Sequence
  Synthetic construct
aaacctcctaggaatggaattcc

SEQ ID NO: 14424 - DNA, 23 bp, Artificial Sequence
  Synthetic construct
aacctcctaggaatggaattccg

SEQ ID NO: 14425 - DNA, 23 bp, Artificial Sequence
  Synthetic construct
acctcctaggaatggaattccgg

SEQ ID NO: 14426 - DNA, 23 bp, Artificial Sequence
  Synthetic construct
cctcctaggaatggaattccggc

SEQ ID NO: 14427 - DNA, 23 bp, Artificial Sequence
  Synthetic construct
ctcctaggaatggaattccggct

SEQ ID NO: 14428 - DNA, 23 bp, Artificial Sequence
  Synthetic construct
tcctaggaatggaattccggcta

SEQ ID NO: 14429 - DNA, 23 bp, Artificial Sequence
  Synthetic construct
cctaggaatggaattccggctac

SEQ ID NO: 14430 - DNA, 23 bp, Artificial Sequence
  Synthetic construct
ctaggaatggaattccggctacc

SEQ ID NO: 14431 - DNA, 23 bp, Artificial Sequence
  Synthetic construct
taggaatggaattccggctacct

SEQ ID NO: 14432 - DNA, 23 bp, Artificial Sequence
  Synthetic construct
aggaatggaattccggctaccta

SEQ ID NO: 14433 - DNA, 23 bp, Artificial Sequence
  Synthetic construct
ggaatggaattccggctacctac

SEQ ID NO: 14434 - DNA, 23 bp, Artificial Sequence
  Synthetic construct
gaatggaattccggctacctaca

SEQ ID NO: 14435 - DNA, 23 bp, Artificial Sequence
  Synthetic construct
aatggaattccggctacctacag

SEQ ID NO: 14436 - DNA, 23 bp, Artificial Sequence
  Synthetic construct
atggaattccggctacctacagc

SEQ ID NO: 14437 - DNA, 23 bp, Artificial Sequence
  Synthetic construct
tggaattccggctacctacagcg

SEQ ID NO: 14438 - DNA, 23 bp, Artificial Sequence
  Synthetic construct
ggaattccggctacctacagcga

SEQ ID NO: 14439 - DNA, 23 bp, Artificial Sequence
  Synthetic construct
gaattccggctacctacagcgat

SEQ ID NO: 14440 - DNA, 23 bp, Artificial Sequence
  Synthetic construct
aattccggctacctacagcgata

SEQ ID NO: 14441 - DNA, 23 bp, Artificial Sequence
  Synthetic construct
attccggctacctacagcgatag

SEQ ID NO: 14442 - DNA, 23 bp, Artificial Sequence
  Synthetic construct
ttccggctacctacagcgatagc

SEQ ID NO: 14443 - DNA, 23 bp, Artificial Sequence
  Synthetic construct
tccggctacctacagcgatagcc

SEQ ID NO: 14444 - DNA, 23 bp, Artificial Sequence
  Synthetic construct
ccggctacctacagcgatagcca

SEQ ID NO: 14445 - DNA, 23 bp, Artificial Sequence
  Synthetic construct
cggctacctacagcgatagccat

SEQ ID NO: 14446 - DNA, 23 bp, Artificial Sequence
  Synthetic construct
ggctacctacagcgatagccatg

SEQ ID NO: 14447 - DNA, 23 bp, Artificial Sequence
  Synthetic construct
gctacctacagcgatagccatgg

SEQ ID NO: 14448 - DNA, 23 bp, Artificial Sequence
  Synthetic construct
ctacctacagcgatagccatggt

SEQ ID NO: 14449 - DNA, 23 bp, Artificial Sequence
  Synthetic construct
tacctacagcgatagccatggta

SEQ ID NO: 14450 - DNA, 23 bp, Artificial Sequence
  Synthetic construct
acctacagcgatagccatggtag

SEQ ID NO: 14451 - DNA, 23 bp, Artificial Sequence
  Synthetic construct
cctacagcgatagccatggtagc

SEQ ID NO: 14452 - DNA, 23 bp, Artificial Sequence
  Synthetic construct
ctacagcgatagccatggtagcg

SEQ ID NO: 14453 - DNA, 23 bp, Artificial Sequence
  Synthetic construct
tacagcgatagccatggtagcgt

SEQ ID NO: 14454 - DNA, 23 bp, Artificial Sequence
  Synthetic construct
acagcgatagccatggtagcgtc

SEQ ID NO: 14455 - DNA, 23 bp, Artificial Sequence
  Synthetic construct
cagcgatagccatggtagcgtct

SEQ ID NO: 14456 - DNA, 23 bp, Artificial Sequence
  Synthetic construct
agcgatagccatggtagcgtctc

SEQ ID NO: 14457 - DNA, 23 bp, Artificial Sequence
  Synthetic construct
gcgatagccatggtagcgtctcg

SEQ ID NO: 14458 - DNA, 23 bp, Artificial Sequence
  Synthetic construct
cgatagccatggtagcgtctcgc

SEQ ID NO: 14459 - DNA, 23 bp, Artificial Sequence
  Synthetic construct
gatagccatggtagcgtctcgct

SEQ ID NO: 14460 - DNA, 23 bp, Artificial Sequence
  Synthetic construct
atagccatggtagcgtctcgcta

SEQ ID NO: 14461 - DNA, 23 bp, Artificial Sequence
  Synthetic construct
tagccatggtagcgtctcgctaa

SEQ ID NO: 14462 - DNA, 23 bp, Artificial Sequence
  Synthetic construct
agccatggtagcgtctcgctaaa

SEQ ID NO: 14463 - DNA, 23 bp, Artificial Sequence
  Synthetic construct
gccatggtagcgtctcgctaaag

SEQ ID NO: 14464 - DNA, 23 bp, Artificial Sequence
  Synthetic construct
ccatggtagcgtctcgctaaaga

SEQ ID NO: 14465 - DNA, 23 bp, Artificial Sequence
  Synthetic construct
catggtagcgtctcgctaaagac

SEQ ID NO: 14466 - DNA, 23 bp, Artificial Sequence
  Synthetic construct
atggtagcgtctcgctaaagaca

SEQ ID NO: 14467 - DNA, 23 bp, Artificial Sequence
  Synthetic construct
tggtagcgtctcgctaaagacat

SEQ ID NO: 14468 - DNA, 23 bp, Artificial Sequence
  Synthetic construct
ggtagcgtctcgctaaagacatt

SEQ ID NO: 14469 - DNA, 23 bp, Artificial Sequence
  Synthetic construct
gtagcgtctcgctaaagacatta

SEQ ID NO: 14470 - DNA, 23 bp, Artificial Sequence
  Synthetic construct
tagcgtctcgctaaagacattaa

SEQ ID NO: 14471 - DNA, 23 bp, Artificial Sequence
  Synthetic construct
agcgtctcgctaaagacattaaa

SEQ ID NO: 14472 - DNA, 23 bp, Artificial Sequence
  Synthetic construct
gcgtctcgctaaagacattaaaa

SEQ ID NO: 14473 - DNA, 23 bp, Artificial Sequence
  Synthetic construct
cgtctcgctaaagacattaaaaa

SEQ ID NO: 14474 - DNA, 23 bp, Artificial Sequence
  Synthetic construct
gtctcgctaaagacattaaaaat

SEQ ID NO: 14475 - DNA, 23 bp, Artificial Sequence
  Synthetic construct
tctcgctaaagacattaaaaatg

SEQ ID NO: 14476 - DNA, 23 bp, Artificial Sequence
  Synthetic construct
ctcgctaaagacattaaaaatgg

SEQ ID NO: 14477 - DNA, 23 bp, Artificial Sequence
  Synthetic construct
tcgctaaagacattaaaaatggc

SEQ ID NO: 14478 - DNA, 23 bp, Artificial Sequence
  Synthetic construct
cgctaaagacattaaaaatggca

SEQ ID NO: 14479 - DNA, 23 bp, Artificial Sequence
  Synthetic construct
gctaaagacattaaaaatggcat

SEQ ID NO: 14480 - DNA, 23 bp, Artificial Sequence
  Synthetic construct
ctaaagacattaaaaatggcatt

SEQ ID NO: 14481 - DNA, 23 bp, Artificial Sequence
  Synthetic construct
taaagacattaaaaatggcatta

SEQ ID NO: 14482 - DNA, 23 bp, Artificial Sequence
  Synthetic construct
aaagacattaaaaatggcattag

SEQ ID NO: 14483 - DNA, 23 bp, Artificial Sequence
  Synthetic construct
aagacattaaaaatggcattagc

SEQ ID NO: 14484 - DNA, 23 bp, Artificial Sequence
  Synthetic construct
agacattaaaaatggcattagct

SEQ ID NO: 14485 - DNA, 23 bp, Artificial Sequence
  Synthetic construct
gacattaaaaatggcattagctc

SEQ ID NO: 14486 - DNA, 23 bp, Artificial Sequence
  Synthetic construct
acattaaaaatggcattagctcg

SEQ ID NO: 14487 - DNA, 23 bp, Artificial Sequence
  Synthetic construct
cattaaaaatggcattagctcga

SEQ ID NO: 14488 - DNA, 23 bp, Artificial Sequence
  Synthetic construct
attaaaaatggcattagctcgac

SEQ ID NO: 14489 - DNA, 23 bp, Artificial Sequence
  Synthetic construct
ttaaaaatggcattagctcgaca

SEQ ID NO: 14490 - DNA, 23 bp, Artificial Sequence
  Synthetic construct
taaaaatggcattagctcgacag

SEQ ID NO: 14491 - DNA, 23 bp, Artificial Sequence
  Synthetic construct
aaaaatggcattagctcgacagg

SEQ ID NO: 14492 - DNA, 23 bp, Artificial Sequence
  Synthetic construct
aaaatggcattagctcgacagga

SEQ ID NO: 14493 - DNA, 23 bp, Artificial Sequence
  Synthetic construct
aaatggcattagctcgacaggaa

SEQ ID NO: 14494 - DNA, 23 bp, Artificial Sequence
  Synthetic construct
aatggcattagctcgacaggaag

SEQ ID NO: 14495 - DNA, 23 bp, Artificial Sequence
  Synthetic construct
atggcattagctcgacaggaagt

SEQ ID NO: 14496 - DNA, 23 bp, Artificial Sequence
  Synthetic construct
tggcattagctcgacaggaagtt

SEQ ID NO: 14497 - DNA, 23 bp, Artificial Sequence
  Synthetic construct
ggcattagctcgacaggaagttg

SEQ ID NO: 14498 - DNA, 23 bp, Artificial Sequence
  Synthetic construct
gcattagctcgacaggaagttga

SEQ ID NO: 14499 - DNA, 23 bp, Artificial Sequence
  Synthetic construct
cattagctcgacaggaagttgag

SEQ ID NO: 14500 - DNA, 23 bp, Artificial Sequence
  Synthetic construct
attagctcgacaggaagttgagc

SEQ ID NO: 14501 - DNA, 23 bp, Artificial Sequence
  Synthetic construct
ttagctcgacaggaagttgagca

SEQ ID NO: 14502 - DNA, 23 bp, Artificial Sequence
  Synthetic construct
tagctcgacaggaagttgagcag

SEQ ID NO: 14503 - DNA, 23 bp, Artificial Sequence
  Synthetic construct
agctcgacaggaagttgagcagg

SEQ ID NO: 14504 - DNA, 23 bp, Artificial Sequence
  Synthetic construct
gctcgacaggaagttgagcagga

SEQ ID NO: 14505 - DNA, 23 bp, Artificial Sequence
  Synthetic construct
ctcgacaggaagttgagcaggac

SEQ ID NO: 14506 - DNA, 23 bp, Artificial Sequence
  Synthetic construct
tcgacaggaagttgagcaggacc

SEQ ID NO: 14507 - DNA, 23 bp, Artificial Sequence
  Synthetic construct
cgacaggaagttgagcaggaccc

SEQ ID NO: 14508 - DNA, 23 bp, Artificial Sequence
  Synthetic construct
gacaggaagttgagcaggacccc

SEQ ID NO: 14509 - DNA, 23 bp, Artificial Sequence
  Synthetic construct
acaggaagttgagcaggaccccg

SEQ ID NO: 14510 - DNA, 23 bp, Artificial Sequence
  Synthetic construct
caggaagttgagcaggaccccga

SEQ ID NO: 14511 - DNA, 23 bp, Artificial Sequence
  Synthetic construct
aggaagttgagcaggaccccgaa

SEQ ID NO: 14512 - DNA, 23 bp, Artificial Sequence
  Synthetic construct
ggaagttgagcaggaccccgaaa

SEQ ID NO: 14513 - DNA, 23 bp, Artificial Sequence
  Synthetic construct
gaagttgagcaggaccccgaaag

SEQ ID NO: 14514 - DNA, 23 bp, Artificial Sequence
  Synthetic construct
aagttgagcaggaccccgaaagg

SEQ ID NO: 14515 - DNA, 23 bp, Artificial Sequence
  Synthetic construct
agttgagcaggaccccgaaaggg

SEQ ID NO: 14516 - DNA, 23 bp, Artificial Sequence
  Synthetic construct
gttgagcaggaccccgaaagggg

SEQ ID NO: 14517 - DNA, 23 bp, Artificial Sequence
  Synthetic construct
ttgagcaggaccccgaaaggggt

SEQ ID NO: 14518 - DNA, 23 bp, Artificial Sequence
  Synthetic construct
tgagcaggaccccgaaaggggtc

SEQ ID NO: 14519 - DNA, 23 bp, Artificial Sequence
  Synthetic construct
gagcaggaccccgaaaggggtcc

SEQ ID NO: 14520 - DNA, 23 bp, Artificial Sequence
  Synthetic construct
agcaggaccccgaaaggggtccc

SEQ ID NO: 14521 - DNA, 23 bp, Artificial Sequence
  Synthetic construct
gcaggaccccgaaaggggtccca

SEQ ID NO: 14522 - DNA, 23 bp, Artificial Sequence
  Synthetic construct
caggaccccgaaaggggtcccac

SEQ ID NO: 14523 - DNA, 23 bp, Artificial Sequence
  Synthetic construct
aggaccccgaaaggggtcccacc

SEQ ID NO: 14524 - DNA, 20 bp, Artificial Sequence
  Synthetic construct
tggtttcacgagccaggggc

SEQ ID NO: 14525 - DNA, 20 bp, Artificial Sequence
  Synthetic construct
tgaagggactaggagattca

SEQ ID NO: 14526 - DNA, 23 bp, Artificial Sequence
  Synthetic construct
tgtgctgcaggcttttgccgagg

SEQ ID NO: 14527 - DNA, 20 bp, Artificial Sequence
  Synthetic construct
accgcgccacttcatgcaga

SEQ ID NO: 14528 - DNA, 21 bp, Artificial Sequence
  Synthetic construct
acgcccaagcatgtcacgcgg

SEQ ID NO: 14529 - DNA, 23 bp, Artificial Sequence
  Synthetic construct
accgccagagaggtactggagtg

SEQ ID NO: 14530 - DNA, 23 bp, Artificial Sequence
  Synthetic construct
aggattcacgtgaacgtaagtca

SEQ ID NO: 14531 - DNA, 22 bp, Artificial Sequence
  Synthetic construct
agccgttaatgagcatggctag

SEQ ID NO: 14532 - DNA, 22 bp, Artificial Sequence
  Synthetic construct
gacagcgctatggaggtaacgg

SEQ ID NO: 14533 - DNA, 23 bp, Artificial Sequence
  Synthetic construct
agggaggtcttcagatcttcgta

SEQ ID NO: 14534 - DNA, 22 bp, Artificial Sequence
  Synthetic construct
cacggaatatgtcatattaagt

SEQ ID NO: 14535 - DNA, 23 bp, Artificial Sequence
  Synthetic construct
gagttgcgcttggaactcatgct

SEQ ID NO: 14536 - DNA, 23 bp, Artificial Sequence
  Synthetic construct
tggatcaagtgatacgcggcctt

SEQ ID NO: 14537 - DNA, 23 bp, Artificial Sequence
  Synthetic construct
ggcgaactgtattctacccttgg

SEQ ID NO: 14538 - DNA, 21 bp, Artificial Sequence
  Synthetic construct
ggaccgcgggctgaacacgcc

SEQ ID NO: 14539 - DNA, 23 bp, Artificial Sequence
  Synthetic construct
attgacaagccaacactacatgg

SEQ ID NO: 14540 - DNA, 20 bp, Artificial Sequence
  Synthetic construct
taggaagaacaccacggttg

SEQ ID NO: 14541 - DNA, 20 bp, Artificial Sequence
  Synthetic construct
agaaaggccgcttcaatttt

SEQ ID NO: 14542 - DNA, 22 bp, Artificial Sequence
  Synthetic construct
ttctgtctgcaccatcgtccgg

SEQ ID NO: 14543 - DNA, 22 bp, Artificial Sequence
  Synthetic construct
tacggaccggtctcagggaatt

SEQ ID NO: 14544 - DNA, 23 bp, Artificial Sequence
  Synthetic construct
atcacggcttccgtcacgcgcgc

SEQ ID NO: 14545 - DNA, 20 bp, Artificial Sequence
  Synthetic construct
gaccatactcctaggtataa

SEQ ID NO: 14546 - DNA, 20 bp, Artificial Sequence
  Synthetic construct
taccgtgaccttgactccta

SEQ ID NO: 14547 - DNA, 22 bp, Artificial Sequence
  Synthetic construct
ccgctctgcgccgagaggacaa

SEQ ID NO: 14548 - DNA, 22 bp, Artificial Sequence
  Synthetic construct
atctcaagcatttgaatggtct

SEQ ID NO: 14549 - DNA, 23 bp, Artificial Sequence
  Synthetic construct
tatattaggccgcaataacgatg

SEQ ID NO: 14550 - DNA, 23 bp, Artificial Sequence
  Synthetic construct
cggtttcatcaccgtctaacgtc

SEQ ID NO: 14551 - DNA, 23 bp, Artificial Sequence
  Synthetic construct
tagggaccagccccccaagagat

SEQ ID NO: 14552 - DNA, 20 bp, Artificial Sequence
  Synthetic construct
tgaactggctcctaaaaccc

SEQ ID NO: 14553 - DNA, 21 bp, Artificial Sequence
  Synthetic construct
acagctcgcaccctcgcattc

SEQ ID NO: 14554 - DNA, 23 bp, Artificial Sequence
  Synthetic construct
cctcgttagccgccacggtcggg

SEQ ID NO: 14555 - DNA, 22 bp, Artificial Sequence
  Synthetic construct
cagccgtgggctggagggtagg

SEQ ID NO: 14556 - DNA, 20 bp, Artificial Sequence
  Synthetic construct
gccacgctgtcttatatgct

SEQ ID NO: 14557 - DNA, 22 bp, Artificial Sequence
  Synthetic construct
ctgcaatgcactcaccaggtga

SEQ ID NO: 14558 - DNA, 21 bp, Artificial Sequence
  Synthetic construct
ctacgggctgaagcccagggc

SEQ ID NO: 14559 - DNA, 22 bp, Artificial Sequence
  Synthetic construct
tttaatgctcgcgatattaacg

SEQ ID NO: 14560 - DNA, 22 bp, Artificial Sequence
  Synthetic construct
ttctgaaatcccacgtagaatg

SEQ ID NO: 14561 - DNA, 23 bp, Artificial Sequence
  Synthetic construct
gtggatcgaactacggtctctgc

SEQ ID NO: 14562 - DNA, 20 bp, Artificial Sequence
  Synthetic construct
tgagggagcagagagaaaca

SEQ ID NO: 14563 - DNA, 20 bp, Artificial Sequence
  Synthetic construct
ccggacggtttctcttcggg

SEQ ID NO: 14564 - DNA, 20 bp, Artificial Sequence
  Synthetic construct
tctcatacaggacagcctcg

SEQ ID NO: 14565 - DNA, 21 bp, Artificial Sequence
  Synthetic construct
gcattgagctcacttcaaatt

SEQ ID NO: 14566 - DNA, 21 bp, Artificial Sequence
  Synthetic construct
caagagattgacgggtcgggt

SEQ ID NO: 14567 - DNA, 22 bp, Artificial Sequence
  Synthetic construct
tttaaatagcctagtgtggaac

SEQ ID NO: 14568 - DNA, 22 bp, Artificial Sequence
  Synthetic construct
ccagccgaaaccttcgtagcag

SEQ ID NO: 14569 - DNA, 23 bp, Artificial Sequence
  Synthetic construct
ggacggaacctcgcagttgagcc

SEQ ID NO: 14570 - DNA, 22 bp, Artificial Sequence
  Synthetic construct
gacggcactaggaagaggctca

SEQ ID NO: 14571 - DNA, 23 bp, Artificial Sequence
  Synthetic construct
tataccgctttcagttttcattt

SEQ ID NO: 14572 - DNA, 23 bp, Artificial Sequence
  Synthetic construct
cggaactaaactcgacgatctac

SEQ ID NO: 14573 - DNA, 21 bp, Artificial Sequence
  Synthetic construct
agaccacgcttcctgccattg

SEQ ID NO: 14574 - DNA, 22 bp, Artificial Sequence
  Synthetic construct
cgctcagtgcttgtaaagttgt

SEQ ID NO: 14575 - DNA, 20 bp, Artificial Sequence
  Synthetic construct
accgcgcactcgggtgtgaa

SEQ ID NO: 14576 - DNA, 22 bp, Artificial Sequence
  Synthetic construct
acgaggatgcatagttctgaag

SEQ ID NO: 14577 - DNA, 23 bp, Artificial Sequence
  Synthetic construct
cgctcacggactctctgtgccac

SEQ ID NO: 14578 - DNA, 22 bp, Artificial Sequence
  Synthetic construct
cttctgtaccggaaccaatcat

SEQ ID NO: 14579 - DNA, 20 bp, Artificial Sequence
  Synthetic construct
aggaattggtataacgtcct

SEQ ID NO: 14580 - DNA, 20 bp, Artificial Sequence
  Synthetic construct
gatacacatacagcgatcat

SEQ ID NO: 14581 - DNA, 22 bp, Artificial Sequence
  Synthetic construct
catcgccatgagtcgaagggct

SEQ ID NO: 14582 - DNA, 23 bp, Artificial Sequence
  Synthetic construct
catccacttgggcagattcctga

SEQ ID NO: 14583 - DNA, 23 bp, Artificial Sequence
  Synthetic construct
tcgtcccccgctagttgagtcag

SEQ ID NO: 14584 - DNA, 22 bp, Artificial Sequence
  Synthetic construct
tatgttgtgtagaccttcgata

SEQ ID NO: 14585 - DNA, 21 bp, Artificial Sequence
  Synthetic construct
ggggggtcagctaccgccctt

SEQ ID NO: 14586 - DNA, 20 bp, Artificial Sequence
  Synthetic construct
cgtatagccgtggtctgcac

SEQ ID NO: 14587 - DNA, 22 bp, Artificial Sequence
  Synthetic construct
ctagaggccgaagatgaggcgg

SEQ ID NO: 14588 - DNA, 21 bp, Artificial Sequence
  Synthetic construct
ccgattagggtagtgcgaaac

SEQ ID NO: 14589 - DNA, 20 bp, Artificial Sequence
  Synthetic construct
cgaacttaccaaaagactct

SEQ ID NO: 14590 - DNA, 21 bp, Artificial Sequence
  Synthetic construct
gatacatgctctcggaggaca

SEQ ID NO: 14591 - DNA, 21 bp, Artificial Sequence
  Synthetic construct
actccaaacgttgaccatgtt

SEQ ID NO: 14592 - DNA, 21 bp, Artificial Sequence
  Synthetic construct
tctttagcctgtagagggcct

SEQ ID NO: 14593 - DNA, 20 bp, Artificial Sequence
  Synthetic construct
gttgtatgtcacgccgatcg

SEQ ID NO: 14594 - DNA, 22 bp, Artificial Sequence
  Synthetic construct
agcccagaattgtgccaacaat

SEQ ID NO: 14595 - DNA, 20 bp, Artificial Sequence
  Synthetic construct
gaccgtctcgccgactacgg

SEQ ID NO: 14596 - DNA, 21 bp, Artificial Sequence
  Synthetic construct
tttaagactgctatcacgggt

SEQ ID NO: 14597 - DNA, 22 bp, Artificial Sequence
  Synthetic construct
aatatggtactgatggtccgat

SEQ ID NO: 14598 - DNA, 22 bp, Artificial Sequence
  Synthetic construct
tagacgaatatggcacgacgta

SEQ ID NO: 14599 - DNA, 20 bp, Artificial Sequence
  Synthetic construct
cccttaatagattaccaggc

SEQ ID NO: 14600 - DNA, 20 bp, Artificial Sequence
  Synthetic construct
ctcataacggggcacgcgag

SEQ ID NO: 14601 - DNA, 20 bp, Artificial Sequence
  Synthetic construct
ttgcgcaccgggggcgagta

SEQ ID NO: 14602 - DNA, 21 bp, Artificial Sequence
  Synthetic construct
gatacttaaacatagcgcttc

SEQ ID NO: 14603 - DNA, 21 bp, Artificial Sequence
  Synthetic construct
atacgcggtgttctgacccgt

SEQ ID NO: 14604 - DNA, 22 bp, Artificial Sequence
  Synthetic construct
tggttggcctcgccactgacct

SEQ ID NO: 14605 - DNA, 23 bp, Artificial Sequence
  Synthetic construct
ccaagacacagacgttattctgt

SEQ ID NO: 14606 - DNA, 21 bp, Artificial Sequence
  Synthetic construct
atcctcagggcaaccatctgg

SEQ ID NO: 14607 - DNA, 20 bp, Artificial Sequence
  Synthetic construct
cgaaacccgtgattttgtgt

SEQ ID NO: 14608 - DNA, 21 bp, Artificial Sequence
  Synthetic construct
ctcgatcacatcggaaggtgt

SEQ ID NO: 14609 - DNA, 20 bp, Artificial Sequence
  Synthetic construct
gagcttccttcagggtaacg

SEQ ID NO: 14610 - DNA, 21 bp, Artificial Sequence
  Synthetic construct
taactgccgccgtagaaacta

SEQ ID NO: 14611 - DNA, 20 bp, Artificial Sequence
  Synthetic construct
tttatgagtactcacaggaa

SEQ ID NO: 14612 - DNA, 22 bp, Artificial Sequence
  Synthetic construct
ctacgggtacatgaagtccata

SEQ ID NO: 14613 - DNA, 20 bp, Artificial Sequence
  Synthetic construct
atcacggcaccgatggctca

SEQ ID NO: 14614 - DNA, 22 bp, Artificial Sequence
  Synthetic construct
gtacgacatatacgcagggtga

SEQ ID NO: 14615 - DNA, 21 bp, Artificial Sequence
  Synthetic construct
ggtgacaacgaggtcgtaaat

SEQ ID NO: 14616 - DNA, 20 bp, Artificial Sequence
  Synthetic construct
gcacctaatgtatggtttat

SEQ ID NO: 14617 - DNA, 21 bp, Artificial Sequence
  Synthetic construct
attcgtagacggaactctgca

SEQ ID NO: 14618 - DNA, 21 bp, Artificial Sequence
  Synthetic construct
gttattcatccctcggaaaaa

SEQ ID NO: 14619 - DNA, 20 bp, Artificial Sequence
  Synthetic construct
ggcttcgtctaaggctagtg

SEQ ID NO: 14620 - DNA, 21 bp, Artificial Sequence
  Synthetic construct
acattgatggagcgttgaaac

SEQ ID NO: 14621 - DNA, 21 bp, Artificial Sequence
  Synthetic construct
gaatgtgttaacggcactctg

SEQ ID NO: 14622 - DNA, 21 bp, Artificial Sequence
  Synthetic construct
cacggaacccctaactaaacc

SEQ ID NO: 14623 - DNA, 20 bp, Artificial Sequence
  Synthetic construct
gtcacggtcagcatcaggca

SEQ ID NO: 14624 - DNA, 21 bp, Artificial Sequence
  Synthetic construct
cgtagcaggccaccctgccgt

SEQ ID NO: 14625 - DNA, 23 bp, Artificial Sequence
  Synthetic construct
gttacgtagcgcagagagggagt

SEQ ID NO: 14626 - DNA, 22 bp, Artificial Sequence
  Synthetic construct
cggccaatcatcctcactgggc

SEQ ID NO: 14627 - DNA, 22 bp, Artificial Sequence
  Synthetic construct
cccacccagtaccccaatagca

SEQ ID NO: 14628 - DNA, 23 bp, Artificial Sequence
  Synthetic construct
agtccagcctcacttacggctgt

SEQ ID NO: 14629 - DNA, 23 bp, Artificial Sequence
  Synthetic construct
gaaacccgttaccgtcttgccct

SEQ ID NO: 14630 - DNA, 21 bp, Artificial Sequence
  Synthetic construct
attgagctcgccggtaccgtc

SEQ ID NO: 14631 - DNA, 23 bp, Artificial Sequence
  Synthetic construct
tcacagacggaagggcgaaaacg

SEQ ID NO: 14632 - DNA, 23 bp, Artificial Sequence
  Synthetic construct
aatatttaagttggtctactggc

SEQ ID NO: 14633 - DNA, 20 bp, Artificial Sequence
  Synthetic construct
tgttcacgtgtgaccgaccc

SEQ ID NO: 14634 - DNA, 20 bp, Artificial Sequence
  Synthetic construct
ccgaactatcgtcggctgga

SEQ ID NO: 14635 - DNA, 23 bp, Artificial Sequence
  Synthetic construct
ctctcgatagccaacggccgaac

SEQ ID NO: 14636 - DNA, 22 bp, Artificial Sequence
  Synthetic construct
gtcaaaacgtcaaaggagatgc

SEQ ID NO: 14637 - DNA, 21 bp, Artificial Sequence
  Synthetic construct
gtcaaccggcgccccgggttt

SEQ ID NO: 14638 - DNA, 20 bp, Artificial Sequence
  Synthetic construct
gcacccgttgcgcggacaga

SEQ ID NO: 14639 - DNA, 22 bp, Artificial Sequence
  Synthetic construct
acaaacgcgtcgtcttagtacc

SEQ ID NO: 14640 - DNA, 20 bp, Artificial Sequence
  Synthetic construct
tcgtactctatgcaactgcc

SEQ ID NO: 14641 - DNA, 21 bp, Artificial Sequence
  Synthetic construct
gacggtctaagagtgcgagag

SEQ ID NO: 14642 - DNA, 23 bp, Artificial Sequence
  Synthetic construct
tctacccattccggcccagtaac

SEQ ID NO: 14643 - DNA, 20 bp, Artificial Sequence
  Synthetic construct
tcgtccgtgtatggctaagg

SEQ ID NO: 14644 - DNA, 23 bp, Artificial Sequence
  Synthetic construct
taactgctagttctatgttgagc

SEQ ID NO: 14645 - DNA, 21 bp, Artificial Sequence
  Synthetic construct
gtgcccgtatagcttcttcga

SEQ ID NO: 14646 - DNA, 20 bp, Artificial Sequence
  Synthetic construct
tcgagcctgccaccgagcgc

SEQ ID NO: 14647 - DNA, 22 bp, Artificial Sequence
  Synthetic construct
ggcaaaagtagtcgacatactt

SEQ ID NO: 14648 - DNA, 20 bp, Artificial Sequence
  Synthetic construct
tgcgcaccggggaaggaggc

SEQ ID NO: 14649 - DNA, 21 bp, Artificial Sequence
  Synthetic construct
ggctgtttacgaaagtatttc

SEQ ID NO: 14650 - DNA, 23 bp, Artificial Sequence
  Synthetic construct
ttcaagatgaaatcaactccctg

SEQ ID NO: 14651 - DNA, 23 bp, Artificial Sequence
  Synthetic construct
tactttcacatctaggggagtcc

SEQ ID NO: 14652 - DNA, 22 bp, Artificial Sequence
  Synthetic construct
cggagctagcagcactttctta

SEQ ID NO: 14653 - DNA, 23 bp, Artificial Sequence
  Synthetic construct
tcggcgacctcggtgcacagctc

SEQ ID NO: 14654 - DNA, 21 bp, Artificial Sequence
  Synthetic construct
tcattaagggattatgccaat

SEQ ID NO: 14655 - DNA, 22 bp, Artificial Sequence
  Synthetic construct
cgctactcagacacgttgtctc

SEQ ID NO: 14656 - DNA, 22 bp, Artificial Sequence
  Synthetic construct
aactacacatatgattttccgg

SEQ ID NO: 14657 - DNA, 20 bp, Artificial Sequence
  Synthetic construct
cgatccataaaggctacgtc

SEQ ID NO: 14658 - DNA, 21 bp, Artificial Sequence
  Synthetic construct
aaggagctcccagggggagca

SEQ ID NO: 14659 - DNA, 22 bp, Artificial Sequence
  Synthetic construct
ttcggtgggactcggaattgat

SEQ ID NO: 14660 - DNA, 22 bp, Artificial Sequence
  Synthetic construct
cgtagcaaactccactgagggg

SEQ ID NO: 14661 - DNA, 20 bp, Artificial Sequence
  Synthetic construct
gacccagccctctgctttgt

SEQ ID NO: 14662 - DNA, 23 bp, Artificial Sequence
  Synthetic construct
caaatgcacgtcggtttgtcgca

SEQ ID NO: 14663 - DNA, 23 bp, Artificial Sequence
  Synthetic construct
gagtctggttgacatttccactg

SEQ ID NO: 14664 - DNA, 23 bp, Artificial Sequence
  Synthetic construct
taattgcacagagctagctcgct

SEQ ID NO: 14665 - DNA, 23 bp, Artificial Sequence
  Synthetic construct
aaaaattactcagatggtctggt

SEQ ID NO: 14666 - DNA, 21 bp, Artificial Sequence
  Synthetic construct
gtcaccccagggattatttat

SEQ ID NO: 14667 - DNA, 23 bp, Artificial Sequence
  Synthetic construct
ggctaatacgaggagaggcagcg

SEQ ID NO: 14668 - DNA, 23 bp, Artificial Sequence
  Synthetic construct
gagcgtacccggactcggccacg

SEQ ID NO: 14669 - DNA, 21 bp, Artificial Sequence
  Synthetic construct
acccattcgcaggtcgctcct

SEQ ID NO: 14670 - DNA, 20 bp, Artificial Sequence
  Synthetic construct
catgtggtaaactgtgcaac

SEQ ID NO: 14671 - DNA, 21 bp, Artificial Sequence
  Synthetic construct
catgcccgcaggccagcccgg

SEQ ID NO: 14672 - DNA, 22 bp, Artificial Sequence
  Synthetic construct
ccgaggaacggaccaccatagg

SEQ ID NO: 14673 - DNA, 22 bp, Artificial Sequence
  Synthetic construct
tagacgagcccaccgcttagac

SEQ ID NO: 14674 - DNA, 20 bp, Artificial Sequence
  Synthetic construct
gagccatgcaagccgctagt

SEQ ID NO: 14675 - DNA, 23 bp, Artificial Sequence
  Synthetic construct
ctcggtaaaagtagttccatcaa

SEQ ID NO: 14676 - DNA, 21 bp, Artificial Sequence
  Synthetic construct
tattggaacaacggcaattcg

SEQ ID NO: 14677 - DNA, 20 bp, Artificial Sequence
  Synthetic construct
gattatcgcttacaatcggc

SEQ ID NO: 14678 - DNA, 21 bp, Artificial Sequence
  Synthetic construct
tagtgcgtggttcgacttagc

SEQ ID NO: 14679 - DNA, 23 bp, Artificial Sequence
  Synthetic construct
gctcgatcgtatcttgtgatcat

SEQ ID NO: 14680 - DNA, 20 bp, Artificial Sequence
  Synthetic construct
ccaggcggcaacactggagc

SEQ ID NO: 14681 - DNA, 22 bp, Artificial Sequence
  Synthetic construct
actggttggagcgaagggagta

SEQ ID NO: 14682 - DNA, 23 bp, Artificial Sequence
  Synthetic construct
ttatactactagatagcgtaggg

SEQ ID NO: 14683 - DNA, 23 bp, Artificial Sequence
  Synthetic construct
gactccgcgaacggggcgtacac

SEQ ID NO: 14684 - DNA, 20 bp, Artificial Sequence
  Synthetic construct
ttaacacgagattcacaggt

SEQ ID NO: 14685 - DNA, 20 bp, Artificial Sequence
  Synthetic construct
ctgtgaatgagctgacctcg

SEQ ID NO: 14686 - DNA, 21 bp, Artificial Sequence
  Synthetic construct
tattaattagcagcaccagac

SEQ ID NO: 14687 - DNA, 22 bp, Artificial Sequence
  Synthetic construct
acactcttcgtattaggtctcc

SEQ ID NO: 14688 - DNA, 23 bp, Artificial Sequence
  Synthetic construct
agttgctttcaagttatattgcg

SEQ ID NO: 14689 - DNA, 20 bp, Artificial Sequence
  Synthetic construct
tttactggactgccggtaac

SEQ ID NO: 14690 - DNA, 22 bp, Artificial Sequence
  Synthetic construct
tccactacgaaatcctatggcg

SEQ ID NO: 14691 - DNA, 21 bp, Artificial Sequence
  Synthetic construct
caggtgcaggatcaagaagtg

SEQ ID NO: 14692 - DNA, 23 bp, Artificial Sequence
  Synthetic construct
ctagcagatcatgctattgtata

SEQ ID NO: 14693 - DNA, 21 bp, Artificial Sequence
  Synthetic construct
ctgtacaacgatctttcgggt

SEQ ID NO: 14694 - DNA, 21 bp, Artificial Sequence
  Synthetic construct
ctaagacgtagcggaatacta

SEQ ID NO: 14695 - DNA, 22 bp, Artificial Sequence
  Synthetic construct
aggtatagcctctactacagat

SEQ ID NO: 14696 - DNA, 20 bp, Artificial Sequence
  Synthetic construct
aggtgaggaaccctaacggc

SEQ ID NO: 14697 - DNA, 20 bp, Artificial Sequence
  Synthetic construct
ccccactggcgcgcagacgg

SEQ ID NO: 14698 - DNA, 22 bp, Artificial Sequence
  Synthetic construct
ggattgttgtgacctagggccc

SEQ ID NO: 14699 - DNA, 23 bp, Artificial Sequence
  Synthetic construct
agtcgcgaacaggggactaaatt

SEQ ID NO: 14700 - DNA, 22 bp, Artificial Sequence
  Synthetic construct
tcctgccatatataatctatct

SEQ ID NO: 14701 - DNA, 20 bp, Artificial Sequence
  Synthetic construct
gaggagctcaagccctaaag

SEQ ID NO: 14702 - DNA, 21 bp, Artificial Sequence
  Synthetic construct
tagatcggttaccaaatgcct

SEQ ID NO: 14703 - DNA, 23 bp, Artificial Sequence
  Synthetic construct
ccatggccgtctaccatacggaa

SEQ ID NO: 14704 - DNA, 22 bp, Artificial Sequence
  Synthetic construct
gtggaagcgagtcctgaggagc

SEQ ID NO: 14705 - DNA, 20 bp, Artificial Sequence
  Synthetic construct
ccgcaagcgccgttagcttc

SEQ ID NO: 14706 - DNA, 22 bp, Artificial Sequence
  Synthetic construct
agagtctcatatgtactttgat

SEQ ID NO: 14707 - DNA, 21 bp, Artificial Sequence
  Synthetic construct
actgtggttctggtaagaccc

SEQ ID NO: 14708 - DNA, 20 bp, Artificial Sequence
  Synthetic construct
aaccggagctcaggcaaaaa

SEQ ID NO: 14709 - DNA, 22 bp, Artificial Sequence
  Synthetic construct
ccggtcgtccaatctagaaggt

SEQ ID NO: 14710 - DNA, 21 bp, Artificial Sequence
  Synthetic construct
gatgtatccccccgccctcca

SEQ ID NO: 14711 - DNA, 23 bp, Artificial Sequence
  Synthetic construct
gtcgtaccctcgccaccgctttt

SEQ ID NO: 14712 - DNA, 22 bp, Artificial Sequence
  Synthetic construct
gtcaggtactcctcactgagga

SEQ ID NO: 14713 - DNA, 21 bp, Artificial Sequence
  Synthetic construct
agagggctgcaataataccgg

SEQ ID NO: 14714 - DNA, 20 bp, Artificial Sequence
  Synthetic construct
cacagctcatcgcagttacg

SEQ ID NO: 14715 - DNA, 23 bp, Artificial Sequence
  Synthetic construct
gtgaacaactagactgatctttc

SEQ ID NO: 14716 - DNA, 21 bp, Artificial Sequence
  Synthetic construct
gagcgcaagggagggacattg

SEQ ID NO: 14717 - DNA, 23 bp, Artificial Sequence
  Synthetic construct
gacgacaacccttttgatcagga

SEQ ID NO: 14718 - DNA, 23 bp, Artificial Sequence
  Synthetic construct
gacataatggctgatatctccat

SEQ ID NO: 14719 - DNA, 23 bp, Artificial Sequence
  Synthetic construct
gccctggggcgacccggtaaatc

SEQ ID NO: 14720 - DNA, 23 bp, Artificial Sequence
  Synthetic construct
caccatagctaacgtcctcagga

SEQ ID NO: 14721 - DNA, 23 bp, Artificial Sequence
  Synthetic construct
gtagcagccatagtagcttcaac

SEQ ID NO: 14722 - DNA, 23 bp, Artificial Sequence
  Synthetic construct
taaagacccaaggctcggcggtg

SEQ ID NO: 14723 - DNA, 21 bp, Artificial Sequence
  Synthetic construct
tgcgaatcctacatttaacgt

SEQ ID NO: 14724 - DNA, 23 bp, Artificial Sequence
  Synthetic construct
gaggattatactcctgaccgcca

SEQ ID NO: 14725 - DNA, 23 bp, Artificial Sequence
  Synthetic construct
cgccagcgtcgcggattcagggt

SEQ ID NO: 14726 - DNA, 22 bp, Artificial Sequence
  Synthetic construct
cgtcggccgaagccacctgctg

SEQ ID NO: 14727 - DNA, 22 bp, Artificial Sequence
  Synthetic construct
gcgtactctttgttgatacaat

SEQ ID NO: 14728 - DNA, 20 bp, Artificial Sequence
  Synthetic construct
ggagccggccctgtgcttga

SEQ ID NO: 14729 - DNA, 20 bp, Artificial Sequence
  Synthetic construct
ctccgtcacctgttcgccta

SEQ ID NO: 14730 - DNA, 20 bp, Artificial Sequence
  Synthetic construct
tctgacctcattcggaggaa

SEQ ID NO: 14731 - DNA, 22 bp, Artificial Sequence
  Synthetic construct
ggggtgccgttcaaaggtggat

SEQ ID NO: 14732 - DNA, 22 bp, Artificial Sequence
  Synthetic construct
tgtcaggcccaagctccaaggt

SEQ ID NO: 14733 - DNA, 21 bp, Artificial Sequence
  Synthetic construct
gatcatggttcaagccggaaa

SEQ ID NO: 14734 - DNA, 23 bp, Artificial Sequence
  Synthetic construct
aagacacgggtatcggcttatgt

SEQ ID NO: 14735 - DNA, 21 bp, Artificial Sequence
  Synthetic construct
cgcaaattatcgatacgcgac

SEQ ID NO: 14736 - DNA, 21 bp, Artificial Sequence
  Synthetic construct
agagagtcaccacgcggcgtt

SEQ ID NO: 14737 - DNA, 23 bp, Artificial Sequence
  Synthetic construct
aacgcctgagcagcctcaagcga

SEQ ID NO: 14738 - DNA, 22 bp, Artificial Sequence
  Synthetic construct
ccccgattgggaaggcgtcgcc

SEQ ID NO: 14739 - DNA, 23 bp, Artificial Sequence
  Synthetic construct
gttaagatctttagcgccagcaa

SEQ ID NO: 14740 - DNA, 22 bp, Artificial Sequence
  Synthetic construct
tgagcgggccgtgcgacgagga

SEQ ID NO: 14741 - DNA, 21 bp, Artificial Sequence
  Synthetic construct
agggccattgctatagtccgg

SEQ ID NO: 14742 - DNA, 22 bp, Artificial Sequence
  Synthetic construct
acctgtatgcaaattcacgctt

SEQ ID NO: 14743 - DNA, 23 bp, Artificial Sequence
  Synthetic construct
aatattccctacgaaacgggtgg

SEQ ID NO: 14744 - DNA, 21 bp, Artificial Sequence
  Synthetic construct
ataagaggggggccacaccag

SEQ ID NO: 14745 - DNA, 21 bp, Artificial Sequence
  Synthetic construct
gactttccattcgcggggatt

SEQ ID NO: 14746 - DNA, 23 bp, Artificial Sequence
  Synthetic construct
tgggaacccttagacggggtggc

SEQ ID NO: 14747 - DNA, 21 bp, Artificial Sequence
  Synthetic construct
tcctgctaacgcttggtcaga

SEQ ID NO: 14748 - DNA, 23 bp, Artificial Sequence
  Synthetic construct
ccagactggtcgctgacgagact

SEQ ID NO: 14749 - DNA, 21 bp, Artificial Sequence
  Synthetic construct
cccggctgggccattttatta

SEQ ID NO: 14750 - DNA, 20 bp, Artificial Sequence
  Synthetic construct
gtaccagttgtcagctattt

SEQ ID NO: 14751 - DNA, 21 bp, Artificial Sequence
  Synthetic construct
caaccgattgttttcgaggcg

SEQ ID NO: 14752 - DNA, 22 bp, Artificial Sequence
  Synthetic construct
catgcctcccgaccccccttta

SEQ ID NO: 14753 - DNA, 22 bp, Artificial Sequence
  Synthetic construct
tgtgtatacggatcttggtcac

SEQ ID NO: 14754 - DNA, 20 bp, Artificial Sequence
  Synthetic construct
tcgctaatgccttcagtggc

SEQ ID NO: 14755 - DNA, 20 bp, Artificial Sequence
  Synthetic construct
gatccttccatcgatgcccg

SEQ ID NO: 14756 - DNA, 23 bp, Artificial Sequence
  Synthetic construct
tcgttatttgataagcgtattca

SEQ ID NO: 14757 - DNA, 22 bp, Artificial Sequence
  Synthetic construct
ttaggacttttatcatccgaac

SEQ ID NO: 14758 - DNA, 21 bp, Artificial Sequence
  Synthetic construct
ccagcgagctcgcagtatagg

SEQ ID NO: 14759 - DNA, 21 bp, Artificial Sequence
  Synthetic construct
actatcaggccaggcggtcct

SEQ ID NO: 14760 - DNA, 23 bp, Artificial Sequence
  Synthetic construct
tcacgccgagcgagtgtgcatgc

SEQ ID NO: 14761 - DNA, 22 bp, Artificial Sequence
  Synthetic construct
acgacgcgaagtgacgcccatt

SEQ ID NO: 14762 - DNA, 21 bp, Artificial Sequence
  Synthetic construct
cgtcttaaaattagccgtatt

SEQ ID NO: 14763 - DNA, 20 bp, Artificial Sequence
  Synthetic construct
caagctcttgtgtctgatcg

SEQ ID NO: 14764 - DNA, 20 bp, Artificial Sequence
  Synthetic construct
cgggccgtccttccagatag

SEQ ID NO: 14765 - DNA, 21 bp, Artificial Sequence
  Synthetic construct
cgtaggggccctggccacctc

SEQ ID NO: 14766 - DNA, 21 bp, Artificial Sequence
  Synthetic construct
gcgtctgaacctcggatcgta

SEQ ID NO: 14767 - DNA, 22 bp, Artificial Sequence
  Synthetic construct
gaagacgcgcactggagaggag

SEQ ID NO: 14768 - DNA, 20 bp, Artificial Sequence
  Synthetic construct
gcagcaggtcgctgccacgg

SEQ ID NO: 14769 - DNA, 21 bp, Artificial Sequence
  Synthetic construct
tgtgcgagttataggtgccag

SEQ ID NO: 14770 - DNA, 22 bp, Artificial Sequence
  Synthetic construct
aatcgcctaacggatctcatat

SEQ ID NO: 14771 - DNA, 23 bp, Artificial Sequence
  Synthetic construct
atcgtttacccggcgcccctatt

SEQ ID NO: 14772 - DNA, 21 bp, Artificial Sequence
  Synthetic construct
catgggtccacatggcggcga

SEQ ID NO: 14773 - DNA, 21 bp, Artificial Sequence
  Synthetic construct
aaaggtgaataccgagatatt

SEQ ID NO: 14774 - DNA, 23 bp, Artificial Sequence
  Synthetic construct
cacccgccctccagattgttagc

SEQ ID NO: 14775 - DNA, 20 bp, Artificial Sequence
  Synthetic construct
cgcgcattcatgggttttag

SEQ ID NO: 14776 - DNA, 21 bp, Artificial Sequence
  Synthetic construct
gactgtctcaccgactacagt

SEQ ID NO: 14777 - DNA, 22 bp, Artificial Sequence
  Synthetic construct
atcgcaccgtcactgctcctct

SEQ ID NO: 14778 - DNA, 21 bp, Artificial Sequence
  Synthetic construct
cgggtgcctatctcgtgtggc

SEQ ID NO: 14779 - DNA, 22 bp, Artificial Sequence
  Synthetic construct
gtattacgaataaatgggacga

SEQ ID NO: 14780 - DNA, 23 bp, Artificial Sequence
  Synthetic construct
ggaagttgtgaaccgtctcagta

SEQ ID NO: 14781 - DNA, 21 bp, Artificial Sequence
  Synthetic construct
caggatagttaattcgggcgt

SEQ ID NO: 14782 - DNA, 22 bp, Artificial Sequence
  Synthetic construct
gaaggccagtgactctgctctt

SEQ ID NO: 14783 - DNA, 20 bp, Artificial Sequence
  Synthetic construct
ccttcaattccatgcgtgaa

SEQ ID NO: 14784 - DNA, 20 bp, Artificial Sequence
  Synthetic construct
cttgcacggagcgaccttaa

SEQ ID NO: 14785 - DNA, 23 bp, Artificial Sequence
  Synthetic construct
ctcacggactgatctacctccgg

SEQ ID NO: 14786 - DNA, 21 bp, Artificial Sequence
  Synthetic construct
atccattacagcccgaccgcc

SEQ ID NO: 14787 - DNA, 20 bp, Artificial Sequence
  Synthetic construct
aaactcgaaaacgcgacgtg

SEQ ID NO: 14788 - DNA, 20 bp, Artificial Sequence
  Synthetic construct
tttgcctgatgaataaatat

SEQ ID NO: 14789 - DNA, 20 bp, Artificial Sequence
  Synthetic construct
tatcagttagctgcggcgcg

SEQ ID NO: 14790 - DNA, 23 bp, Artificial Sequence
  Synthetic construct
ctctcaaaaggctttgactgggt

SEQ ID NO: 14791 - DNA, 20 bp, Artificial Sequence
  Synthetic construct
ctcaaggaaggcctgcgata

SEQ ID NO: 14792 - DNA, 21 bp, Artificial Sequence
  Synthetic construct
ctaagactaatcgtgaggaag

SEQ ID NO: 14793 - DNA, 22 bp, Artificial Sequence
  Synthetic construct
tcgctgcgacaagccccttcga

SEQ ID NO: 14794 - DNA, 20 bp, Artificial Sequence
  Synthetic construct
ctttctggtcgggacctttc

SEQ ID NO: 14795 - DNA, 21 bp, Artificial Sequence
  Synthetic construct
gaaaatccggtacgtctcatc

SEQ ID NO: 14796 - DNA, 20 bp, Artificial Sequence
  Synthetic construct
gatcagatgcggggtagcag

SEQ ID NO: 14797 - DNA, 21 bp, Artificial Sequence
  Synthetic construct
tcggcctgcacgccacgagta

SEQ ID NO: 14798 - DNA, 20 bp, Artificial Sequence
  Synthetic construct
agacagttataaggcaggtc

SEQ ID NO: 14799 - DNA, 20 bp, Artificial Sequence
  Synthetic construct
agggccagacgaagcatcgc

SEQ ID NO: 14800 - DNA, 20 bp, Artificial Sequence
  Synthetic construct
tgtaaatgcccttacaactg

SEQ ID NO: 14801 - DNA, 20 bp, Artificial Sequence
  Synthetic construct
gcgtacgccgtgattgcgtg

SEQ ID NO: 14802 - DNA, 22 bp, Artificial Sequence
  Synthetic construct
ccgacggcaaaaaatgtttacc

SEQ ID NO: 14803 - DNA, 23 bp, Artificial Sequence
  Synthetic construct
cgtgggacacagcctccgcccag

SEQ ID NO: 14804 - DNA, 23 bp, Artificial Sequence
  Synthetic construct
taactgctcgagggtcggctatc

SEQ ID NO: 14805 - DNA, 22 bp, Artificial Sequence
  Synthetic construct
aaattattcgcctaactgctgg

SEQ ID NO: 14806 - DNA, 22 bp, Artificial Sequence
  Synthetic construct
gaagacgttcgcctagccggtc

SEQ ID NO: 14807 - DNA, 22 bp, Artificial Sequence
  Synthetic construct
ccatcccatgtttgatgaaaca

SEQ ID NO: 14808 - DNA, 22 bp, Artificial Sequence
  Synthetic construct
caagcccgaccagggcagtagc

SEQ ID NO: 14809 - DNA, 21 bp, Artificial Sequence
  Synthetic construct
atcctagacagcccgtgatgc

SEQ ID NO: 14810 - DNA, 23 bp, Artificial Sequence
  Synthetic construct
taggacttgttcaacatctcggc

SEQ ID NO: 14811 - DNA, 22 bp, Artificial Sequence
  Synthetic construct
tgagcttgtccgtcagccattc

SEQ ID NO: 14812 - DNA, 23 bp, Artificial Sequence
  Synthetic construct
gttcaattacgcacagcgtaatg

SEQ ID NO: 14813 - DNA, 23 bp, Artificial Sequence
  Synthetic construct
tatcccggactaggggtagaccg

SEQ ID NO: 14814 - DNA, 22 bp, Artificial Sequence
  Synthetic construct
accgaagctggcttgttggtcg

SEQ ID NO: 14815 - DNA, 20 bp, Artificial Sequence
  Synthetic construct
agatcatagttgagcatgac

SEQ ID NO: 14816 - DNA, 20 bp, Artificial Sequence
  Synthetic construct
ttgcggaataccttatcaac

SEQ ID NO: 14817 - DNA, 21 bp, Artificial Sequence
  Synthetic construct
aagcctactacgcaaacccag

SEQ ID NO: 14818 - DNA, 20 bp, Artificial Sequence
  Synthetic construct
attgggcgcgcatgatagca

SEQ ID NO: 14819 - DNA, 20 bp, Artificial Sequence
  Synthetic construct
tatgggaaaatactcaagat

SEQ ID NO: 14820 - DNA, 23 bp, Artificial Sequence
  Synthetic construct
caagcctccagcaagcttctcga

SEQ ID NO: 14821 - DNA, 22 bp, Artificial Sequence
  Synthetic construct
gattacgtgtacggacacctct

SEQ ID NO: 14822 - DNA, 23 bp, Artificial Sequence
  Synthetic construct
ctcgtccgtcatctgcctggcgg

SEQ ID NO: 14823 - DNA, 22 bp, Artificial Sequence
  Synthetic construct
atagtacatctacataggctca

SEQ ID NO: 14824 - DNA, 22 bp, Artificial Sequence
  Synthetic construct
cctcaaaagcgtattcgggtgg

SEQ ID NO: 14825 - DNA, 20 bp, Artificial Sequence
  Synthetic construct
cgtctagcagttgcgactat

SEQ ID NO: 14826 - DNA, 20 bp, Artificial Sequence
  Synthetic construct
gtggttttgcgcgaatccga

SEQ ID NO: 14827 - DNA, 20 bp, Artificial Sequence
  Synthetic construct
tactaccggggaattaactt

SEQ ID NO: 14828 - DNA, 22 bp, Artificial Sequence
  Synthetic construct
gttggtttgtccgtaacgagtt

SEQ ID NO: 14829 - DNA, 23 bp, Artificial Sequence
  Synthetic construct
tcacgatattatcgtaaagaacc

SEQ ID NO: 14830 - DNA, 20 bp, Artificial Sequence
  Synthetic construct
taatatccctcgcattgcag

SEQ ID NO: 14831 - DNA, 20 bp, Artificial Sequence
  Synthetic construct
cactgttatgcttacccaaa

SEQ ID NO: 14832 - DNA, 23 bp, Artificial Sequence
  Synthetic construct
accaatgaggcgcgattcctcgt

SEQ ID NO: 14833 - DNA, 22 bp, Artificial Sequence
  Synthetic construct
ttcgctctctagaactctgtac

SEQ ID NO: 14834 - DNA, 23 bp, Artificial Sequence
  Synthetic construct
aaccgagcaaaaccccgcttcaa

SEQ ID NO: 14835 - DNA, 23 bp, Artificial Sequence
  Synthetic construct
catggagcggtgtgagcacttcg

SEQ ID NO: 14836 - DNA, 20 bp, Artificial Sequence
  Synthetic construct
ccgcggagtattgcgcttaa

SEQ ID NO: 14837 - DNA, 21 bp, Artificial Sequence
  Synthetic construct
agtacacgcccacaactattc

SEQ ID NO: 14838 - DNA, 20 bp, Artificial Sequence
  Synthetic construct
gaggtagtcacggggctcta

SEQ ID NO: 14839 - DNA, 22 bp, Artificial Sequence
  Synthetic construct
agactcagctccagagaagact

SEQ ID NO: 14840 - DNA, 22 bp, Artificial Sequence
  Synthetic construct
aactcctaggtacctgcacgcg

SEQ ID NO: 14841 - DNA, 21 bp, Artificial Sequence
  Synthetic construct
tcctcgaatagcagatagctt

SEQ ID NO: 14842 - DNA, 20 bp, Artificial Sequence
  Synthetic construct
ctatcgaatatgcaacacgt

SEQ ID NO: 14843 - DNA, 21 bp, Artificial Sequence
  Synthetic construct
acccgatcctgtctcgcctgc

SEQ ID NO: 14844 - DNA, 23 bp, Artificial Sequence
  Synthetic construct
gttcatcggatgttccagaaagt

SEQ ID NO: 14845 - DNA, 22 bp, Artificial Sequence
  Synthetic construct
agggcctcctaccaagctactg

SEQ ID NO: 14846 - DNA, 23 bp, Artificial Sequence
  Synthetic construct
cgggggccccttgctcgccaaga

SEQ ID NO: 14847 - DNA, 23 bp, Artificial Sequence
  Synthetic construct
gtaccaacgtggggacgcgttgt

SEQ ID NO: 14848 - DNA, 23 bp, Artificial Sequence
  Synthetic construct
acttacggtatgacacggtttta

SEQ ID NO: 14849 - DNA, 21 bp, Artificial Sequence
  Synthetic construct
ttccaggctctcagctgcgtc

SEQ ID NO: 14850 - DNA, 23 bp, Artificial Sequence
  Synthetic construct
ccctaagagctgtccaccacgcc

SEQ ID NO: 14851 - DNA, 20 bp, Artificial Sequence
  Synthetic construct
ttcctcctactcgcagatgg

SEQ ID NO: 14852 - DNA, 22 bp, Artificial Sequence
  Synthetic construct
taaggcaatgttttcagcaagt

SEQ ID NO: 14853 - DNA, 22 bp, Artificial Sequence
  Synthetic construct
ggataattattggggtttctca

SEQ ID NO: 14854 - DNA, 22 bp, Artificial Sequence
  Synthetic construct
ttgcctcgaccgggaagacact

SEQ ID NO: 14855 - DNA, 21 bp, Artificial Sequence
  Synthetic construct
cccacgcgctaattgcccaca

SEQ ID NO: 14856 - DNA, 22 bp, Artificial Sequence
  Synthetic construct
gcgtagcagcatcctacgaacc

SEQ ID NO: 14857 - DNA, 20 bp, Artificial Sequence
  Synthetic construct
tgtaatttcggttcctaaaa

SEQ ID NO: 14858 - DNA, 22 bp, Artificial Sequence
  Synthetic construct
caacctcaaaagatatgttcga

SEQ ID NO: 14859 - DNA, 23 bp, Artificial Sequence
  Synthetic construct
acagaaggcgacgttccacgcga

SEQ ID NO: 14860 - DNA, 23 bp, Artificial Sequence
  Synthetic construct
tgagcgaggagagtctgagagcg

SEQ ID NO: 14861 - DNA, 20 bp, Artificial Sequence
  Synthetic construct
gatgagtttataaatcgtaa

SEQ ID NO: 14862 - DNA, 23 bp, Artificial Sequence
  Synthetic construct
attatggcgagaaggggcctgac

SEQ ID NO: 14863 - DNA, 20 bp, Artificial Sequence
  Synthetic construct
ttatttatatctactagcgt

SEQ ID NO: 14864 - DNA, 23 bp, Artificial Sequence
  Synthetic construct
acacttaattgcttgcgtaggta

SEQ ID NO: 14865 - DNA, 22 bp, Artificial Sequence
  Synthetic construct
acacttcaagctaggcccgggg

SEQ ID NO: 14866 - DNA, 23 bp, Artificial Sequence
  Synthetic construct
atttcgcactgcttgtagctgga

SEQ ID NO: 14867 - DNA, 23 bp, Artificial Sequence
  Synthetic construct
ctgctgcttttaacaacaaccgg

SEQ ID NO: 14868 - DNA, 20 bp, Artificial Sequence
  Synthetic construct
tggctacatgcgaattacgc

SEQ ID NO: 14869 - DNA, 23 bp, Artificial Sequence
  Synthetic construct
cttcagatggagataggtccagt

SEQ ID NO: 14870 - DNA, 23 bp, Artificial Sequence
  Synthetic construct
ccttagggcccaaatgagaaatg

SEQ ID NO: 14871 - DNA, 22 bp, Artificial Sequence
  Synthetic construct
taaatggcactcgtttggacta

SEQ ID NO: 14872 - DNA, 22 bp, Artificial Sequence
  Synthetic construct
atggatttttgttcccctcaaa

SEQ ID NO: 14873 - DNA, 20 bp, Artificial Sequence
  Synthetic construct
ggccatcttcccaccttacc

SEQ ID NO: 14874 - DNA, 22 bp, Artificial Sequence
  Synthetic construct
acagctaaagcatatgtaattt

SEQ ID NO: 14875 - DNA, 23 bp, Artificial Sequence
  Synthetic construct
caacacgtactgcttctcagcac

SEQ ID NO: 14876 - DNA, 22 bp, Artificial Sequence
  Synthetic construct
gtatctgagtcccggccgactg

SEQ ID NO: 14877 - DNA, 22 bp, Artificial Sequence
  Synthetic construct
atctgggacgggtacccagtgc

SEQ ID NO: 14878 - DNA, 20 bp, Artificial Sequence
  Synthetic construct
tatgacctccactttagtgg

SEQ ID NO: 14879 - DNA, 21 bp, Artificial Sequence
  Synthetic construct
caagtgtccgaatgtttcatt

SEQ ID NO: 14880 - DNA, 22 bp, Artificial Sequence
  Synthetic construct
tctatttatctcttccaaagaa

SEQ ID NO: 14881 - DNA, 23 bp, Artificial Sequence
  Synthetic construct
cgtacttcaggcggccgcacgcg

SEQ ID NO: 14882 - DNA, 23 bp, Artificial Sequence
  Synthetic construct
tgcttaacgagtgtttcgtaggc

SEQ ID NO: 14883 - DNA, 20 bp, Artificial Sequence
  Synthetic construct
tggaggagagaccgatggct

SEQ ID NO: 14884 - DNA, 23 bp, Artificial Sequence
  Synthetic construct
gcgggactacgactataatttag

SEQ ID NO: 14885 - DNA, 23 bp, Artificial Sequence
  Synthetic construct
ttccccagccacgaaagtagtct

SEQ ID NO: 14886 - DNA, 21 bp, Artificial Sequence
  Synthetic construct
cagtaccctaggcctacaaaa

SEQ ID NO: 14887 - DNA, 20 bp, Artificial Sequence
  Synthetic construct
aaatggttagttaacgaaga

SEQ ID NO: 14888 - DNA, 22 bp, Artificial Sequence
  Synthetic construct
aaaaggtgttaccctttaccca

SEQ ID NO: 14889 - DNA, 21 bp, Artificial Sequence
  Synthetic construct
tcgtctccggtccagctgtcg

SEQ ID NO: 14890 - DNA, 23 bp, Artificial Sequence
  Synthetic construct
gttcaatctaccggcagacagca

SEQ ID NO: 14891 - DNA, 22 bp, Artificial Sequence
  Synthetic construct
ctaggtgcggagatattccaca

SEQ ID NO: 14892 - DNA, 20 bp, Artificial Sequence
  Synthetic construct
accgcggtccgcgaggcgat

SEQ ID NO: 14893 - DNA, 20 bp, Artificial Sequence
  Synthetic construct
gggtacagcttctgttgttt

SEQ ID NO: 14894 - DNA, 23 bp, Artificial Sequence
  Synthetic construct
acagcttctgttgtttcttcaag

SEQ ID NO: 14895 - DNA, 23 bp, Artificial Sequence
  Synthetic construct
tccctgcttaacgagtgtttcgt

SEQ ID NO: 14896 - DNA, 20 bp, Artificial Sequence
  Synthetic construct
gcacctagtctgtgcgccag

SEQ ID NO: 14897 - DNA, 23 bp, Artificial Sequence
  Synthetic construct
gagggatgcccacctgacacctc

SEQ ID NO: 14898 - DNA, 23 bp, Artificial Sequence
  Synthetic construct
gcaagtgtccgaatgtttcattg

SEQ ID NO: 14899 - DNA, 22 bp, Artificial Sequence
  Synthetic construct
gcgtttatgtggtagtttcagc

SEQ ID NO: 14900 - DNA, 21 bp, Artificial Sequence
  Synthetic construct
ataagtgccccccgcaattca

SEQ ID NO: 14901 - DNA, 23 bp, Artificial Sequence
  Synthetic construct
agccatatgtggttctgaggcat

SEQ ID NO: 14902 - DNA, 22 bp, Artificial Sequence
  Synthetic construct
ctccatacagtctaggtgcgga

SEQ ID NO: 14903 - DNA, 22 bp, Artificial Sequence
  Synthetic construct
ctacgtcgcggaatgttcttca

SEQ ID NO: 14904 - DNA, 21 bp, Artificial Sequence
  Synthetic construct
cgacgtttgaaggtctgttgc

SEQ ID NO: 14905 - DNA, 23 bp, Artificial Sequence
  Synthetic construct
cttgctctggaagcaggggaggc

SEQ ID NO: 14906 - DNA, 23 bp, Artificial Sequence
  Synthetic construct
tcaagttgagaaatacataacta

SEQ ID NO: 14907 - DNA, 21 bp, Artificial Sequence
  Synthetic construct
ctagttggtcgcagaccgagt

SEQ ID NO: 14908 - DNA, 21 bp, Artificial Sequence
  Synthetic construct
tgatggggagaggcataagtg

SEQ ID NO: 14909 - DNA, 21 bp, Artificial Sequence
  Synthetic construct
ggacattcggttttgaactga

SEQ ID NO: 14910 - DNA, 21 bp, Artificial Sequence
  Synthetic construct
gccgagaggagggtccacgga

SEQ ID NO: 14911 - DNA, 21 bp, Artificial Sequence
  Synthetic construct
cacacccatgccgagaggagg

SEQ ID NO: 14912 - DNA, 21 bp, Artificial Sequence
  Synthetic construct
gggcacacgatctccgtgaac

SEQ ID NO: 14913 - DNA, 22 bp, Artificial Sequence
  Synthetic construct
ggttgccacgaggataccccgt

SEQ ID NO: 14914 - DNA, 20 bp, Artificial Sequence
  Synthetic construct
ccactaggcgtgtcactgct

SEQ ID NO: 14915 - DNA, 22 bp, Artificial Sequence
  Synthetic construct
atttgctacgtgcaaaccgtac

SEQ ID NO: 14916 - DNA, 23 bp, Artificial Sequence
  Synthetic construct
tagagctagcataggcgagtgtg

SEQ ID NO: 14917 - DNA, 22 bp, Artificial Sequence
  Synthetic construct
catggaggtctttccccagcca

SEQ ID NO: 14918 - DNA, 22 bp, Artificial Sequence
  Synthetic construct
gctatctgaatagcagacgtag

SEQ ID NO: 14919 - DNA, 20 bp, Artificial Sequence
  Synthetic construct
tgaacggatgatgccaaaat

SEQ ID NO: 14920 - DNA, 20 bp, Artificial Sequence
  Synthetic construct
tttcagctccacggatttca

SEQ ID NO: 14921 - DNA, 22 bp, Artificial Sequence
  Synthetic construct
atgtttcattggacatcgcaag

SEQ ID NO: 14922 - DNA, 21 bp, Artificial Sequence
  Synthetic construct
gctagcggaccacacctcaaa

SEQ ID NO: 14923 - DNA, 22 bp, Artificial Sequence
  Synthetic construct
cgcttcacccagtagcacccca

SEQ ID NO: 14924 - DNA, 21 bp, Artificial Sequence
  Synthetic construct
gctgatgatgcatcagtcggg

SEQ ID NO: 14925 - DNA, 22 bp, Artificial Sequence
  Synthetic construct
aagggagtcgttagcgtcgttt

SEQ ID NO: 14926 - DNA, 22 bp, Artificial Sequence
  Synthetic construct
agcaggggaggcaagcgcaaat

SEQ ID NO: 14927 - DNA, 22 bp, Artificial Sequence
  Synthetic construct
aatgggtacagcttctgttgtt

SEQ ID NO: 14928 - DNA, 21 bp, Artificial Sequence
  Synthetic construct
gaccttcgccactaggcgtgt

SEQ ID NO: 14929 - DNA, 23 bp, Artificial Sequence
  Synthetic construct
gcgtgaagcctcaccgattgcgg

SEQ ID NO: 14930 - DNA, 23 bp, Artificial Sequence
  Synthetic construct
agggtggtctcgatataagtata

SEQ ID NO: 14931 - DNA, 23 bp, Artificial Sequence
  Synthetic construct
ttttgtgcaccggccgtccacca

SEQ ID NO: 14932 - DNA, 21 bp, Artificial Sequence
  Synthetic construct
tcgacgtttgaaggtctgttg

SEQ ID NO: 14933 - DNA, 20 bp, Artificial Sequence
  Synthetic construct
gtttaggcaaccatatctgg

SEQ ID NO: 14934 - DNA, 21 bp, Artificial Sequence
  Synthetic construct
gctccctgggggcatttgccc

SEQ ID NO: 14935 - DNA, 23 bp, Artificial Sequence
  Synthetic construct
gctctggaagcaggggaggcaag

SEQ ID NO: 14936 - DNA, 22 bp, Artificial Sequence
  Synthetic construct
tgtcccgtgacgattccgggtt

SEQ ID NO: 14937 - DNA, 20 bp, Artificial Sequence
  Synthetic construct
attattttatctagcccgac

SEQ ID NO: 14938 - DNA, 20 bp, Artificial Sequence
  Synthetic construct
agctcttgcgttcaagaagt

SEQ ID NO: 14939 - DNA, 23 bp, Artificial Sequence
  Synthetic construct
cgatataagtatagagctagcat

SEQ ID NO: 14940 - DNA, 21 bp, Artificial Sequence
  Synthetic construct
gtatttgctacgtgcaaaccg

SEQ ID NO: 14941 - DNA, 21 bp, Artificial Sequence
  Synthetic construct
atgcatttcagaggaaagagc

SEQ ID NO: 14942 - DNA, 21 bp, Artificial Sequence
  Synthetic construct
tgtttggtcgtaggcatcgga

SEQ ID NO: 14943 - DNA, 22 bp, Artificial Sequence
  Synthetic construct
aaatcgctctgcgatggtaccg

SEQ ID NO: 14944 - DNA, 20 bp, Artificial Sequence
  Synthetic construct
ggcatgcagtccagccatga

SEQ ID NO: 14945 - DNA, 22 bp, Artificial Sequence
  Synthetic construct
ctgcggccggtaagtttgtact

SEQ ID NO: 14946 - DNA, 21 bp, Artificial Sequence
  Synthetic construct
ttccacacccatgccgagagg

SEQ ID NO: 14947 - DNA, 22 bp, Artificial Sequence
  Synthetic construct
gcaagcttgacctgagggccag

SEQ ID NO: 14948 - DNA, 21 bp, Artificial Sequence
  Synthetic construct
gggccagcaaaattgagctga

SEQ ID NO: 14949 - DNA, 20 bp, Artificial Sequence
  Synthetic construct
ccatgattgtagttcaatct

SEQ ID NO: 14950 - DNA, 21 bp, Artificial Sequence
  Synthetic construct
ctagtcgagattgagcgcaag

SEQ ID NO: 14951 - DNA, 23 bp, Artificial Sequence
  Synthetic construct
gcagacagcataggtcgacgttt

SEQ ID NO: 14952 - DNA, 22 bp, Artificial Sequence
  Synthetic construct
acaaatgtcaaggcttcttatt

SEQ ID NO: 14953 - DNA, 22 bp, Artificial Sequence
  Synthetic construct
ggagcgctagaaagagagcttt

SEQ ID NO: 14954 - DNA, 22 bp, Artificial Sequence
  Synthetic construct
gtgttgagcgctgcgtttggta

SEQ ID NO: 14955 - DNA, 23 bp, Artificial Sequence
  Synthetic construct
cagtctaggtgcggagatattcc

SEQ ID NO: 14956 - DNA, 21 bp, Artificial Sequence
  Synthetic construct
atacttatacatggaggtctt

SEQ ID NO: 14957 - DNA, 20 bp, Artificial Sequence
  Synthetic construct
gcggatgccgtcagagccat

SEQ ID NO: 14958 - DNA, 22 bp, Artificial Sequence
  Synthetic construct
ccattgatcgacgaaccgatca

SEQ ID NO: 14959 - DNA, 23 bp, Artificial Sequence
  Synthetic construct
tttgctacgtgcaaaccgtacca

SEQ ID NO: 14960 - DNA, 20 bp, Artificial Sequence
  Synthetic construct
cttccaagtggaagttctca

SEQ ID NO: 14961 - DNA, 21 bp, Artificial Sequence
  Synthetic construct
ggctctggttacacgcggcac

SEQ ID NO: 14962 - DNA, 22 bp, Artificial Sequence
  Synthetic construct
gaacagtaccctaggcctacaa

SEQ ID NO: 14963 - DNA, 23 bp, Artificial Sequence
  Synthetic construct
aaccgtaccaacagcagagatcc

SEQ ID NO: 14964 - DNA, 22 bp, Artificial Sequence
  Synthetic construct
acacgcggcacctagtctgtgc

SEQ ID NO: 14965 - DNA, 22 bp, Artificial Sequence
  Synthetic construct
gatgatgccaaaatttggctta

SEQ ID NO: 14966 - DNA, 21 bp, Artificial Sequence
  Synthetic construct
tgctctggaagcaggggaggc

SEQ ID NO: 14967 - DNA, 20 bp, Artificial Sequence
  Synthetic construct
ttgccccacccacacgagct

SEQ ID NO: 14968 - DNA, 22 bp, Artificial Sequence
  Synthetic construct
gagaagggacattcggttttga

SEQ ID NO: 14969 - DNA, 23 bp, Artificial Sequence
  Synthetic construct
gtactgtttaggaacagtaccct

SEQ ID NO: 14970 - DNA, 21 bp, Artificial Sequence
  Synthetic construct
ggtcgacgtttgaaggtctgt

SEQ ID NO: 14971 - DNA, 23 bp, Artificial Sequence
  Synthetic construct
gcgcaagtgtccgaatgtttcat

SEQ ID NO: 14972 - DNA, 21 bp, Artificial Sequence
  Synthetic construct
ggttagttaacgaagacagcg

SEQ ID NO: 14973 - DNA, 23 bp, Artificial Sequence
  Synthetic construct
ctaggcctacaaaatgtttggtc

SEQ ID NO: 14974 - DNA, 22 bp, Artificial Sequence
  Synthetic construct
ctatctagttccacggatgttc

SEQ ID NO: 14975 - DNA, 20 bp, Artificial Sequence
  Synthetic construct
actgctccgctgggcagcat

SEQ ID NO: 14976 - DNA, 20 bp, Artificial Sequence
  Synthetic construct
atgagtcaagcaagagcagc

SEQ ID NO: 14977 - DNA, 22 bp, Artificial Sequence
  Synthetic construct
gtctttccccagccacgaaagt

SEQ ID NO: 14978 - DNA, 21 bp, Artificial Sequence
  Synthetic construct
gaagcattttgcaagcacagg

SEQ ID NO: 14979 - DNA, 20 bp, Artificial Sequence
  Synthetic construct
aactgaatgtagcttcacgg

SEQ ID NO: 14980 - DNA, 22 bp, Artificial Sequence
  Synthetic construct
ggagcccaaaggcagaacgagc

SEQ ID NO: 14981 - DNA, 22 bp, Artificial Sequence
  Synthetic construct
ggcagacagcataggtcgacgt

SEQ ID NO: 14982 - DNA, 21 bp, Artificial Sequence
  Synthetic construct
atccatatcacacccttttcc

SEQ ID NO: 14983 - DNA, 23 bp, Artificial Sequence
  Synthetic construct
tctattgagtaagagaaatttta

SEQ ID NO: 14984 - DNA, 22 bp, Artificial Sequence
  Synthetic construct
gggagtcctcacacccggtcgc

SEQ ID NO: 14985 - DNA, 21 bp, Artificial Sequence
  Synthetic construct
ttctacctttgggctaaggga

SEQ ID NO: 14986 - DNA, 22 bp, Artificial Sequence
  Synthetic construct
ctaggcgtgtcactgctgaaat

SEQ ID NO: 14987 - DNA, 20 bp, Artificial Sequence
  Synthetic construct
gctaccaggtatggaatcta

SEQ ID NO: 14988 - DNA, 20 bp, Artificial Sequence
  Synthetic construct
catgtgacggcgagcagcgc

SEQ ID NO: 14989 - DNA, 21 bp, Artificial Sequence
  Synthetic construct
aagaggttgccacgaggatac

SEQ ID NO: 14990 - DNA, 21 bp, Artificial Sequence
  Synthetic construct
gtgggtcccattaaaattgga

SEQ ID NO: 14991 - DNA, 23 bp, Artificial Sequence
  Synthetic construct
tatccctcttgctctggaagcag

SEQ ID NO: 14992 - DNA, 23 bp, Artificial Sequence
  Synthetic construct
taggtcgacgtttgaaggtctgt

SEQ ID NO: 14993 - DNA, 23 bp, Artificial Sequence
  Synthetic construct
atcccttgcctcacaaatgtcaa

SEQ ID NO: 14994 - DNA, 22 bp, Artificial Sequence
  Synthetic construct
cggaaagagtaagcaacagctg

SEQ ID NO: 14995 - DNA, 21 bp, Artificial Sequence
  Synthetic construct
aagtatagagctagcataggc

SEQ ID NO: 14996 - DNA, 21 bp, Artificial Sequence
  Synthetic construct
cgctgcatagcactataccaa

SEQ ID NO: 14997 - DNA, 21 bp, Artificial Sequence
  Synthetic construct
cttatacatggaggtctttcc

SEQ ID NO: 14998 - DNA, 22 bp, Artificial Sequence
  Synthetic construct
tacagtccttgtcaatgactgc

SEQ ID NO: 14999 - DNA, 23 bp, Artificial Sequence
  Synthetic construct
ttactcactataggtcccacgta

SEQ ID NO: 15000 - DNA, 21 bp, Artificial Sequence
  Synthetic construct
gcgttcaagaagtcgcttttc

SEQ ID NO: 15001 - DNA, 20 bp, Artificial Sequence
  Synthetic construct
gtgcaccggccgtccaccaa

SEQ ID NO: 15002 - DNA, 22 bp, Artificial Sequence
  Synthetic construct
gcgattgccccagcgacttacc

SEQ ID NO: 15003 - DNA, 22 bp, Artificial Sequence
  Synthetic construct
ctggaatccaagaccattactg

SEQ ID NO: 15004 - DNA, 21 bp, Artificial Sequence
  Synthetic construct
agatgcccctgctataatata

SEQ ID NO: 15005 - DNA, 23 bp, Artificial Sequence
  Synthetic construct
agcaacagctgaccgaggatgga

SEQ ID NO: 15006 - DNA, 22 bp, Artificial Sequence
  Synthetic construct
caccacatctcgaaggacatcg

SEQ ID NO: 15007 - DNA, 21 bp, Artificial Sequence
  Synthetic construct
cgtgaagcctcaccgattgcg

SEQ ID NO: 15008 - DNA, 22 bp, Artificial Sequence
  Synthetic construct
tcgagacgcgtcttagcgttta

SEQ ID NO: 15009 - DNA, 23 bp, Artificial Sequence
  Synthetic construct
ccacaacgaaatcgtctccggtc

SEQ ID NO: 15010 - DNA, 22 bp, Artificial Sequence
  Synthetic construct
taggaacagtaccctaggccta

SEQ ID NO: 15011 - DNA, 23 bp, Artificial Sequence
  Synthetic construct
cgagataaccaggctctggttac

SEQ ID NO: 15012 - DNA, 22 bp, Artificial Sequence
  Synthetic construct
ctggaagcaggggaggcaagcg

SEQ ID NO: 15013 - DNA, 22 bp, Artificial Sequence
  Synthetic construct
caatggtgattactcactatag

SEQ ID NO: 15014 - DNA, 22 bp, Artificial Sequence
  Synthetic construct
cgtttgaggccgtagatgatta

SEQ ID NO: 15015 - DNA, 22 bp, Artificial Sequence
  Synthetic construct
ccgagcaacatcccttgcctca

SEQ ID NO: 15016 - DNA, 20 bp, Artificial Sequence
  Synthetic construct
gctttcgccaggccgaggtg

SEQ ID NO: 15017 - DNA, 21 bp, Artificial Sequence
  Synthetic construct
tcttcaagttgagaaatacat

SEQ ID NO: 15018 - DNA, 22 bp, Artificial Sequence
  Synthetic construct
caagaagtcgcttttcgtgctg

SEQ ID NO: 15019 - DNA, 21 bp, Artificial Sequence
  Synthetic construct
ttgcttctagctttcaaagct

SEQ ID NO: 15020 - DNA, 23 bp, Artificial Sequence
  Synthetic construct
tctccgtgaacggatgatgccaa

SEQ ID NO: 15021 - DNA, 23 bp, Artificial Sequence
  Synthetic construct
atcggcgtaccgcaagcatgaat

SEQ ID NO: 15022 - DNA, 21 bp, Artificial Sequence
  Synthetic construct
ccccacccacacgagctttct

SEQ ID NO: 15023 - DNA, 22 bp, Artificial Sequence
  Synthetic construct
gacgattccgggtttagagtcg

SEQ ID NO: 15024 - DNA, 20 bp, Artificial Sequence
  Synthetic construct
ggtcccattaaaattggaac

SEQ ID NO: 15025 - DNA, 22 bp, Artificial Sequence
  Synthetic construct
agaggcataagtgccccccgca

SEQ ID NO: 15026 - DNA, 23 bp, Artificial Sequence
  Synthetic construct
cacccatgccgagaggagggtcc

SEQ ID NO: 15027 - DNA, 23 bp, Artificial Sequence
  Synthetic construct
agaagcattttgcaagcacaggc

SEQ ID NO: 15028 - DNA, 23 bp, Artificial Sequence
  Synthetic construct
tacctagtcgagattgagcgcaa

SEQ ID NO: 15029 - DNA, 22 bp, Artificial Sequence
  Synthetic construct
gcccgagaaagcgctctcgacg

SEQ ID NO: 15030 - DNA, 21 bp, Artificial Sequence
  Synthetic construct
agaggagggtccacggaagct

SEQ ID NO: 15031 - DNA, 21 bp, Artificial Sequence
  Synthetic construct
tgtttcattggacatcgcaag

SEQ ID NO: 15032 - DNA, 20 bp, Artificial Sequence
  Synthetic construct
taccgctctgctatgctacc

SEQ ID NO: 15033 - DNA, 22 bp, Artificial Sequence
  Synthetic construct
gcgatggtaccgatagcgacat

SEQ ID NO: 15034 - DNA, 22 bp, Artificial Sequence
  Synthetic construct
cgccagtctatttatctcttcc

SEQ ID NO: 15035 - DNA, 20 bp, Artificial Sequence
  Synthetic construct
gtaaggatcctccaaactgg

SEQ ID NO: 15036 - DNA, 21 bp, Artificial Sequence
  Synthetic construct
gcttagaagcattttgcaagc

SEQ ID NO: 15037 - DNA, 20 bp, Artificial Sequence
  Synthetic construct
ctcgaaggacatcggcgtac

SEQ ID NO: 15038 - DNA, 21 bp, Artificial Sequence
  Synthetic construct
tccccatgttaggcataccgg

SEQ ID NO: 15039 - DNA, 21 bp, Artificial Sequence
  Synthetic construct
ggcagaacgagcatagcgagc

SEQ ID NO: 15040 - DNA, 20 bp, Artificial Sequence
  Synthetic construct
ctcggactatacttatacat

SEQ ID NO: 15041 - DNA, 23 bp, Artificial Sequence
  Synthetic construct
ttgataaaaggtgttacccttta

SEQ ID NO: 15042 - DNA, 23 bp, Artificial Sequence
  Synthetic construct
aggcataagtgccccccgcaatt

SEQ ID NO: 15043 - DNA, 22 bp, Artificial Sequence
  Synthetic construct
cttattattttatctagcccga

SEQ ID NO: 15044 - DNA, 21 bp, Artificial Sequence
  Synthetic construct
tccatagaacttgggtgatcc

SEQ ID NO: 15045 - DNA, 23 bp, Artificial Sequence
  Synthetic construct
agctagttttgtgcaccggccgt

SEQ ID NO: 15046 - DNA, 21 bp, Artificial Sequence
  Synthetic construct
tccgctgggcagcatggaatc

SEQ ID NO: 15047 - DNA, 20 bp, Artificial Sequence
  Synthetic construct
ctgaccccggttttgctttg

SEQ ID NO: 15048 - DNA, 20 bp, Artificial Sequence
  Synthetic construct
cctgacacctctctgtcccg

SEQ ID NO: 15049 - DNA, 22 bp, Artificial Sequence
  Synthetic construct
atctaccggcagacagcatagg

SEQ ID NO: 15050 - DNA, 20 bp, Artificial Sequence
  Synthetic construct
caaaatgtagttctttggac

SEQ ID NO: 15051 - DNA, 23 bp, Artificial Sequence
  Synthetic construct
ttcaatctaccggcagacagcat

SEQ ID NO: 15052 - DNA, 23 bp, Artificial Sequence
  Synthetic construct
catcgactggctccctgggggca

SEQ ID NO: 15053 - DNA, 22 bp, Artificial Sequence
  Synthetic construct
gcgtgaaaatggcaccacagct

SEQ ID NO: 15054 - DNA, 20 bp, Artificial Sequence
  Synthetic construct
ttgaaggacagctcgattac

SEQ ID NO: 15055 - DNA, 22 bp, Artificial Sequence
  Synthetic construct
gtttcgtaggctggaatccaag

SEQ ID NO: 15056 - DNA, 22 bp, Artificial Sequence
  Synthetic construct
ccattgcggccttggtatccgt

SEQ ID NO: 15057 - DNA, 23 bp, Artificial Sequence
  Synthetic construct
ttgctacgtgcaaaccgtaccaa

SEQ ID NO: 15058 - DNA, 23 bp, Artificial Sequence
  Synthetic construct
ctaatgggtacagcttctgttgt

SEQ ID NO: 15059 - DNA, 21 bp, Artificial Sequence
  Synthetic construct
attgcggccttggtatccgta

SEQ ID NO: 15060 - DNA, 21 bp, Artificial Sequence
  Synthetic construct
cttctattgagtaagagaaat

SEQ ID NO: 15061 - DNA, 23 bp, Artificial Sequence
  Synthetic construct
tccttgtcaatgactgcattatt

SEQ ID NO: 15062 - DNA, 22 bp, Artificial Sequence
  Synthetic construct
aactcgatctcaggtactataa

SEQ ID NO: 15063 - DNA, 23 bp, Artificial Sequence
  Synthetic construct
cagccacgaaagtagtctgcggc

SEQ ID NO: 15064 - DNA, 22 bp, Artificial Sequence
  Synthetic construct
tagcgccagtctatttatctct

SEQ ID NO: 15065 - DNA, 23 bp, Artificial Sequence
  Synthetic construct
aatgtactgtttaggaacagtac

SEQ ID NO: 15066 - DNA, 22 bp, Artificial Sequence
  Synthetic construct
gccagcaaaattgagctgaccc

SEQ ID NO: 15067 - DNA, 23 bp, Artificial Sequence
  Synthetic construct
gtcaaggcttcttattattttat

SEQ ID NO: 15068 - DNA, 20 bp, Artificial Sequence
  Synthetic construct
gatgccttagcatctaccgc

SEQ ID NO: 15069 - DNA, 23 bp, Artificial Sequence
  Synthetic construct
agctggcttcaggacgttttcca

SEQ ID NO: 15070 - DNA, 22 bp, Artificial Sequence
  Synthetic construct
gcttaacgagtgtttcgtaggc

SEQ ID NO: 15071 - DNA, 23 bp, Artificial Sequence
  Synthetic construct
gttccacggatgttcgcttcacc

SEQ ID NO: 15072 - DNA, 22 bp, Artificial Sequence
  Synthetic construct
ttgagctgaccccggttttgct

SEQ ID NO: 15073 - DNA, 22 bp, Artificial Sequence
  Synthetic construct
agcgcaagtgtccgaatgtttc

SEQ ID NO: 15074 - DNA, 20 bp, Artificial Sequence
  Synthetic construct
cttttccacggaaagagtaa

SEQ ID NO: 15075 - DNA, 21 bp, Artificial Sequence
  Synthetic construct
gatataagtatagagctagca

SEQ ID NO: 15076 - DNA, 20 bp, Artificial Sequence
  Synthetic construct
gactggctccctgggggcat

SEQ ID NO: 15077 - DNA, 21 bp, Artificial Sequence
  Synthetic construct
ggccggtaagtttgtactcct

SEQ ID NO: 15078 - DNA, 22 bp, Artificial Sequence
  Synthetic construct
agggtgtaagggagtcctcaca

SEQ ID NO: 15079 - DNA, 23 bp, Artificial Sequence
  Synthetic construct
tggcaccacagctacagtttggc

SEQ ID NO: 15080 - DNA, 20 bp, Artificial Sequence
  Synthetic construct
attaaaattggaaccacaac

SEQ ID NO: 15081 - DNA, 22 bp, Artificial Sequence
  Synthetic construct
aaagagtaagcaacagctgacc

SEQ ID NO: 15082 - DNA, 23 bp, Artificial Sequence
  Synthetic construct
acgtcctacgtcgcggaatgttc

SEQ ID NO: 15083 - DNA, 21 bp, Artificial Sequence
  Synthetic construct
taggtgcggagatattccaca

SEQ ID NO: 15084 - DNA, 23 bp, Artificial Sequence
  Synthetic construct
gacattcctcggactatacttat

SEQ ID NO: 15085 - DNA, 22 bp, Artificial Sequence
  Synthetic construct
gtcgcagaccgagtcgtcccgt

SEQ ID NO: 15086 - DNA, 20 bp, Artificial Sequence
  Synthetic construct
cttggtatccgtagatgccc

SEQ ID NO: 15087 - DNA, 23 bp, Artificial Sequence
  Synthetic construct
tgccgtcagagccatatgtggtt

SEQ ID NO: 15088 - DNA, 22 bp, Artificial Sequence
  Synthetic construct
ggacttactagttagctagttg

SEQ ID NO: 15089 - DNA, 22 bp, Artificial Sequence
  Synthetic construct
actcactataggtcccacgtat

SEQ ID NO: 15090 - DNA, 22 bp, Artificial Sequence
  Synthetic construct
aagtggaagttctcaaagaagg

SEQ ID NO: 15091 - DNA, 23 bp, Artificial Sequence
  Synthetic construct
ttgaactgaatgtagcttcacgg

SEQ ID NO: 15092 - DNA, 20 bp, Artificial Sequence
  Synthetic construct
cccctcaacagcctccatac

SEQ ID NO: 15093 - DNA, 20 bp, Artificial Sequence
  Synthetic construct
gtgcaaaccgtaccaacagc

SEQ ID NO: 15094 - DNA, 22 bp, Artificial Sequence
  Synthetic construct
gcaaaatgtagttctttggaca

SEQ ID NO: 15095 - DNA, 21 bp, Artificial Sequence
  Synthetic construct
atgttcgcttcacccagtagc

SEQ ID NO: 15096 - DNA, 22 bp, Artificial Sequence
  Synthetic construct
ctctggaagcaggggaggcaag

SEQ ID NO: 15097 - DNA, 23 bp, Artificial Sequence
  Synthetic construct
gcgctagaaagagagctttaaat

SEQ ID NO: 15098 - DNA, 21 bp, Artificial Sequence
  Synthetic construct
tgacttctattgagtaagaga

SEQ ID NO: 15099 - DNA, 20 bp, Artificial Sequence
  Synthetic construct
atagcgattcgatgccctcc

SEQ ID NO: 15100 - DNA, 22 bp, Artificial Sequence
  Synthetic construct
agagctagcataggcgagtgtg

SEQ ID NO: 15101 - DNA, 22 bp, Artificial Sequence
  Synthetic construct
cgcaagtgtccgaatgtttcat

SEQ ID NO: 15102 - DNA, 20 bp, Artificial Sequence
  Synthetic construct
tagccgatgccccaacccct

SEQ ID NO: 15103 - DNA, 21 bp, Artificial Sequence
  Synthetic construct
gattatctgcggccggtaagt

SEQ ID NO: 15104 - DNA, 22 bp, Artificial Sequence
  Synthetic construct
gggtgtaagggagtcctcacac

SEQ ID NO: 15105 - DNA, 20 bp, Artificial Sequence
  Synthetic construct
accgaggatggacatccatt

SEQ ID NO: 15106 - DNA, 20 bp, Artificial Sequence
  Synthetic construct
cgttggcaatggggggcgcg

SEQ ID NO: 15107 - DNA, 20 bp, Artificial Sequence
  Synthetic construct
gccgaggtggctttccaccc

SEQ ID NO: 15108 - DNA, 22 bp, Artificial Sequence
  Synthetic construct
ccaccacatctcgaaggacatc

SEQ ID NO: 15109 - DNA, 23 bp, Artificial Sequence
  Synthetic construct
gttagttaacgaagacagcgatg

SEQ ID NO: 15110 - DNA, 20 bp, Artificial Sequence
  Synthetic construct
gcaccctacgaggatgtaca

SEQ ID NO: 15111 - DNA, 22 bp, Artificial Sequence
  Synthetic construct
tcccggaatgccgggggcaccc

SEQ ID NO: 15112 - DNA, 23 bp, Artificial Sequence
  Synthetic construct
tactagttagctagttggtcgca

SEQ ID NO: 15113 - DNA, 21 bp, Artificial Sequence
  Synthetic construct
aagcagtctcgagacgcgtct

SEQ ID NO: 15114 - DNA, 23 bp, Artificial Sequence
  Synthetic construct
ttaggtaaaaccattgcggcctt

SEQ ID NO: 15115 - DNA, 21 bp, Artificial Sequence
  Synthetic construct
cggtcgctcgagaggagccat

SEQ ID NO: 15116 - DNA, 20 bp, Artificial Sequence
  Synthetic construct
ccggccgtccaccaacctca

SEQ ID NO: 15117 - DNA, 20 bp, Artificial Sequence
  Synthetic construct
gttcaagaagtcgcttttcg

SEQ ID NO: 15118 - DNA, 22 bp, Artificial Sequence
  Synthetic construct
agggccagcaaaattgagctga

SEQ ID NO: 15119 - DNA, 21 bp, Artificial Sequence
  Synthetic construct
tttagtggctgtcgtacttca

SEQ ID NO: 15120 - DNA, 22 bp, Artificial Sequence
  Synthetic construct
cgagctcccggaatgccggggg

SEQ ID NO: 15121 - DNA, 20 bp, Artificial Sequence
  Synthetic construct
accaaaatgtatttgctacg

SEQ ID NO: 15122 - DNA, 21 bp, Artificial Sequence
  Synthetic construct
ttatacatggaggtctttccc

SEQ ID NO: 15123 - DNA, 21 bp, Artificial Sequence
  Synthetic construct
cgttgaagcgattgccccagc

SEQ ID NO: 15124 - DNA, 21 bp, Artificial Sequence
  Synthetic construct
aggggaggcaagcgcaaatgc

SEQ ID NO: 15125 - DNA, 22 bp, Artificial Sequence
  Synthetic construct
ccctggagggggatttctctcc

SEQ ID NO: 15126 - DNA, 22 bp, Artificial Sequence
  Synthetic construct
agaggagggtccacggaagcta

SEQ ID NO: 15127 - DNA, 21 bp, Artificial Sequence
  Synthetic construct
cagtccagccatgattgtagt

SEQ ID NO: 15128 - DNA, 22 bp, Artificial Sequence
  Synthetic construct
gttttgctttgtcaccgtgatg

SEQ ID NO: 15129 - DNA, 20 bp, Artificial Sequence
  Synthetic construct
agtgtttcgtaggctggaat

SEQ ID NO: 15130 - DNA, 20 bp, Artificial Sequence
  Synthetic construct
ccgtgatggggagaggcata

SEQ ID NO: 15131 - DNA, 22 bp, Artificial Sequence
  Synthetic construct
ggttaaaagcgatgcttaaggc

SEQ ID NO: 15132 - DNA, 22 bp, Artificial Sequence
  Synthetic construct
cttactagttagctagttggtc

SEQ ID NO: 15133 - DNA, 20 bp, Artificial Sequence
  Synthetic construct
actagttagctagttggtcg

SEQ ID NO: 15134 - DNA, 20 bp, Artificial Sequence
  Synthetic construct
agagggagctgcgtgcgagg

SEQ ID NO: 15135 - DNA, 23 bp, Artificial Sequence
  Synthetic construct
gcttccaagtggaagttctcaaa

SEQ ID NO: 15136 - DNA, 22 bp, Artificial Sequence
  Synthetic construct
cgaatgcttccaagtggaagtt

SEQ ID NO: 15137 - DNA, 21 bp, Artificial Sequence
  Synthetic construct
ggacatcgcaagcagtctcga

SEQ ID NO: 15138 - DNA, 23 bp, Artificial Sequence
  Synthetic construct
atcatgggaactatccctcttgc

SEQ ID NO: 15139 - DNA, 21 bp, Artificial Sequence
  Synthetic construct
cctctctgtcccgtgacgatt

SEQ ID NO: 15140 - DNA, 22 bp, Artificial Sequence
  Synthetic construct
acgagctcccggaatgccgggg

SEQ ID NO: 15141 - DNA, 22 bp, Artificial Sequence
  Synthetic construct
cgtgaagcctcaccgattgcgg

SEQ ID NO: 15142 - DNA, 20 bp, Artificial Sequence
  Synthetic construct
agctttcaaagctagttttg

SEQ ID NO: 15143 - DNA, 21 bp, Artificial Sequence
  Synthetic construct
tatccctcttgctctggaagc

SEQ ID NO: 15144 - DNA, 23 bp, Artificial Sequence
  Synthetic construct
cggccgcacgcgcaatatgcgtg

SEQ ID NO: 15145 - DNA, 21 bp, Artificial Sequence
  Synthetic construct
gtaattagtccgttgccgaga

SEQ ID NO: 15146 - DNA, 22 bp, Artificial Sequence
  Synthetic construct
gcgtgaagcctcaccgattgcg

SEQ ID NO: 15147 - DNA, 21 bp, Artificial Sequence
  Synthetic construct
tccgtgaacggatgatgccaa

SEQ ID NO: 15148 - DNA, 22 bp, Artificial Sequence
  Synthetic construct
ctagcagcaacaaacccgttac

SEQ ID NO: 15149 - DNA, 20 bp, Artificial Sequence
  Synthetic construct
gcgcctgccactctgacttc

SEQ ID NO: 15150 - DNA, 20 bp, Artificial Sequence
  Synthetic construct
gtcgcatctaccaagcgaac

SEQ ID NO: 15151 - DNA, 21 bp, Artificial Sequence
  Synthetic construct
aaactcgatctcaggtactat

SEQ ID NO: 15152 - DNA, 22 bp, Artificial Sequence
  Synthetic construct
ccagtagcaccccagcgggcat

SEQ ID NO: 15153 - DNA, 20 bp, Artificial Sequence
  Synthetic construct
tccactttagtggctgtcgt

SEQ ID NO: 15154 - DNA, 20 bp, Artificial Sequence
  Synthetic construct
gcagaacgagcatagcgagc

SEQ ID NO: 15155 - DNA, 23 bp, Artificial Sequence
  Synthetic construct
cacacccttttccacggaaagag

SEQ ID NO: 15156 - DNA, 20 bp, Artificial Sequence
  Synthetic construct
gatggtaccgatagcgacat

SEQ ID NO: 15157 - DNA, 21 bp, Artificial Sequence
  Synthetic construct
gggcagcatggaatcgatagc

SEQ ID NO: 15158 - DNA, 22 bp, Artificial Sequence
  Synthetic construct
gaggttgccacgaggatacccc

SEQ ID NO: 15159 - DNA, 22 bp, Artificial Sequence
  Synthetic construct
ccctcttgctctggaagcaggg

SEQ ID NO: 15160 - DNA, 23 bp, Artificial Sequence
  Synthetic construct
caccaacctcaacgtcaagccaa

SEQ ID NO: 15161 - DNA, 21 bp, Artificial Sequence
  Synthetic construct
caccgattgcggccaagggtg

SEQ ID NO: 15162 - DNA, 20 bp, Artificial Sequence
  Synthetic construct
ctgatgatgcatcagtcggg

SEQ ID NO: 15163 - DNA, 22 bp, Artificial Sequence
  Synthetic construct
agacccgttatcagtttcgctg

SEQ ID NO: 15164 - DNA, 23 bp, Artificial Sequence
  Synthetic construct
taagtatagagctagcataggcg

SEQ ID NO: 15165 - DNA, 21 bp, Artificial Sequence
  Synthetic construct
gttgaaggacagctcgattac

SEQ ID NO: 15166 - DNA, 21 bp, Artificial Sequence
  Synthetic construct
caggtatggaatctacgcaat

SEQ ID NO: 15167 - DNA, 20 bp, Artificial Sequence
  Synthetic construct
tcaccgtgatggggagaggc

SEQ ID NO: 15168 - DNA, 23 bp, Artificial Sequence
  Synthetic construct
ggctgtcgtacttcaggcggccg

SEQ ID NO: 15169 - DNA, 23 bp, Artificial Sequence
  Synthetic construct
tgcaaaccgtaccaacagcagag

SEQ ID NO: 15170 - DNA, 23 bp, Artificial Sequence
  Synthetic construct
gattgaaatgagtcaagcaagag

SEQ ID NO: 15171 - DNA, 20 bp, Artificial Sequence
  Synthetic construct
gtaccgatagcgacatccat

SEQ ID NO: 15172 - DNA, 23 bp, Artificial Sequence
  Synthetic construct
acgctcgaaaatcatgggaacta

SEQ ID NO: 15173 - DNA, 20 bp, Artificial Sequence
  Synthetic construct
agcggggttcgttgaagcga

SEQ ID NO: 15174 - DNA, 20 bp, Artificial Sequence
  Synthetic construct
accagcgatgtatcgcacca

SEQ ID NO: 15175 - DNA, 23 bp, Artificial Sequence
  Synthetic construct
ggggcacacgatctccgtgaacg

SEQ ID NO: 15176 - DNA, 21 bp, Artificial Sequence
  Synthetic construct
aatgggtacagcttctgttgt

SEQ ID NO: 15177 - DNA, 22 bp, Artificial Sequence
  Synthetic construct
cgctgctatctgaatagcagac

SEQ ID NO: 15178 - DNA, 23 bp, Artificial Sequence
  Synthetic construct
agagaaattttatagcaagcttg

SEQ ID NO: 15179 - DNA, 23 bp, Artificial Sequence
  Synthetic construct
agttctcaaagaaggatactctc

SEQ ID NO: 15180 - DNA, 20 bp, Artificial Sequence
  Synthetic construct
ggaacagtaccctaggccta

SEQ ID NO: 15181 - DNA, 22 bp, Artificial Sequence
  Synthetic construct
cgtttgaaggtctgttgcacgt

SEQ ID NO: 15182 - DNA, 22 bp, Artificial Sequence
  Synthetic construct
gacgagttgaaggacagctcga

SEQ ID NO: 15183 - DNA, 23 bp, Artificial Sequence
  Synthetic construct
gatgattatctgcggccggtaag

SEQ ID NO: 15184 - DNA, 23 bp, Artificial Sequence
  Synthetic construct
acgttgtatagcgctgcatagca

SEQ ID NO: 15185 - DNA, 21 bp, Artificial Sequence
  Synthetic construct
agcgtttatgtggtagtttca

SEQ ID NO: 15186 - DNA, 20 bp, Artificial Sequence
  Synthetic construct
agaagtcgcttttcgtgctg

SEQ ID NO: 15187 - DNA, 20 bp, Artificial Sequence
  Synthetic construct
gagcgctagaaagagagctt

SEQ ID NO: 15188 - DNA, 21 bp, Artificial Sequence
  Synthetic construct
tcaatctaccggcagacagca

SEQ ID NO: 15189 - DNA, 21 bp, Artificial Sequence
  Synthetic construct
aggtgttaccctttacccaag

SEQ ID NO: 15190 - DNA, 20 bp, Artificial Sequence
  Synthetic construct
cggaccacacctcaaaagag

SEQ ID NO: 15191 - DNA, 22 bp, Artificial Sequence
  Synthetic construct
atagcgattcgatgccctccgc

SEQ ID NO: 15192 - DNA, 23 bp, Artificial Sequence
  Synthetic construct
ccgtaccaacagcagagatccat

SEQ ID NO: 15193 - DNA, 20 bp, Artificial Sequence
  Synthetic construct
gagtcgttagcgtcgtttga

SEQ ID NO: 15194 - DNA, 23 bp, Artificial Sequence
  Synthetic construct
tcgcatctaccaagcgaacgctg

SEQ ID NO: 15195 - DNA, 22 bp, Artificial Sequence
  Synthetic construct
aaaatttggcttagaagcattt

SEQ ID NO: 15196 - DNA, 23 bp, Artificial Sequence
  Synthetic construct
cgcaagtgtccgaatgtttcatt

SEQ ID NO: 15197 - DNA, 22 bp, Artificial Sequence
  Synthetic construct
gagtgttgagcgctgcgtttgg

SEQ ID NO: 15198 - DNA, 23 bp, Artificial Sequence
  Synthetic construct
aagccaaccaatggtgattactc

SEQ ID NO: 15199 - DNA, 20 bp, Artificial Sequence
  Synthetic construct
aaaccattgatcgacgaacc

SEQ ID NO: 15200 - DNA, 22 bp, Artificial Sequence
  Synthetic construct
tacctagtcgagattgagcgca

SEQ ID NO: 15201 - DNA, 22 bp, Artificial Sequence
  Synthetic construct
ccacggaagctacaagaagcca

SEQ ID NO: 15202 - DNA, 21 bp, Artificial Sequence
  Synthetic construct
gcaccacagctacagtttggc

SEQ ID NO: 15203 - DNA, 22 bp, Artificial Sequence
  Synthetic construct
tatacagggtcactctaacgtg

SEQ ID NO: 15204 - DNA, 21 bp, Artificial Sequence
  Synthetic construct
tctggacttactagttagcta

SEQ ID NO: 15205 - DNA, 22 bp, Artificial Sequence
  Synthetic construct
tctattgagtaagagaaatttt

SEQ ID NO: 15206 - DNA, 22 bp, Artificial Sequence
  Synthetic construct
taccaacagcagagatccatag

SEQ ID NO: 15207 - DNA, 22 bp, Artificial Sequence
  Synthetic construct
cctcttgctctggaagcagggg

SEQ ID NO: 15208 - DNA, 23 bp, Artificial Sequence
  Synthetic construct
ctcaaagaaggatactctcggca

SEQ ID NO: 15209 - DNA, 23 bp, Artificial Sequence
  Synthetic construct
cgcctgccactctgacttctatt

SEQ ID NO: 15210 - DNA, 23 bp, Artificial Sequence
  Synthetic construct
tgggctaagggagtcgttagcgt

SEQ ID NO: 15211 - DNA, 21 bp, Artificial Sequence
  Synthetic construct
tctgctatgctacccttgata

SEQ ID NO: 15212 - DNA, 20 bp, Artificial Sequence
  Synthetic construct
cagagccatatgtggttctg

SEQ ID NO: 15213 - DNA, 22 bp, Artificial Sequence
  Synthetic construct
tagaaggagcgctagaaagaga

SEQ ID NO: 15214 - DNA, 21 bp, Artificial Sequence
  Synthetic construct
agtttggcaaaatgtagttct

SEQ ID NO: 15215 - DNA, 22 bp, Artificial Sequence
  Synthetic construct
agtttgtactcctaatgggtac

SEQ ID NO: 15216 - DNA, 23 bp, Artificial Sequence
  Synthetic construct
taccctttacccaagtgtaaact

SEQ ID NO: 15217 - DNA, 23 bp, Artificial Sequence
  Synthetic construct
cgagactctcgccgagataacca

SEQ ID NO: 15218 - DNA, 20 bp, Artificial Sequence
  Synthetic construct
ggtcgcagaccgagtcgtcc

SEQ ID NO: 15219 - DNA, 23 bp, Artificial Sequence
  Synthetic construct
tagcggaccacacctcaaaagag

SEQ ID NO: 15220 - DNA, 20 bp, Artificial Sequence
  Synthetic construct
tcttcaagcgacttgttcgt

SEQ ID NO: 15221 - DNA, 22 bp, Artificial Sequence
  Synthetic construct
ctcaacgtcaagccaaccaatg

SEQ ID NO: 15222 - DNA, 22 bp, Artificial Sequence
  Synthetic construct
agatattccacacccatgccga

SEQ ID NO: 15223 - DNA, 21 bp, Artificial Sequence
  Synthetic construct
aaagccgaagagggagctgcg

SEQ ID NO: 15224 - DNA, 23 bp, Artificial Sequence
  Synthetic construct
aattggaaccacaacgaaatcgt

SEQ ID NO: 15225 - DNA, 23 bp, Artificial Sequence
  Synthetic construct
ttccacggatgttcgcttcaccc

SEQ ID NO: 15226 - DNA, 20 bp, Artificial Sequence
  Synthetic construct
ccgacgagcgcctatgggca

SEQ ID NO: 15227 - DNA, 22 bp, Artificial Sequence
  Synthetic construct
agaagggacattcggttttgaa

SEQ ID NO: 15228 - DNA, 23 bp, Artificial Sequence
  Synthetic construct
tacagaaatcgctctgcgatggt

SEQ ID NO: 15229 - DNA, 20 bp, Artificial Sequence
  Synthetic construct
cgagtttaggcaaccatatc

SEQ ID NO: 15230 - DNA, 20 bp, Artificial Sequence
  Synthetic construct
ttcacccagtagcaccccag

SEQ ID NO: 15231 - DNA, 21 bp, Artificial Sequence
  Synthetic construct
ctacctttgggctaagggagt

SEQ ID NO: 15232 - DNA, 23 bp, Artificial Sequence
  Synthetic construct
aaggtccctgggccgaagcccgc

SEQ ID NO: 15233 - DNA, 23 bp, Artificial Sequence
  Synthetic construct
caggtccctgggccgaagcccgc

SEQ ID NO: 15234 - DNA, 23 bp, Artificial Sequence
  Synthetic construct
taggtccctgggccgaagcccgc

SEQ ID NO: 15235 - DNA, 23 bp, Artificial Sequence
  Synthetic construct
gcggtccctgggccgaagcccgc

SEQ ID NO: 15236 - DNA, 23 bp, Artificial Sequence
  Synthetic construct
ggggtccctgggccgaagcccgc

SEQ ID NO: 15237 - DNA, 23 bp, Artificial Sequence
  Synthetic construct
gtggtccctgggccgaagcccgc

SEQ ID NO: 15238 - DNA, 23 bp, Artificial Sequence
  Synthetic construct
gaagtccctgggccgaagcccgc

SEQ ID NO: 15239 - DNA, 23 bp, Artificial Sequence
  Synthetic construct
gacgtccctgggccgaagcccgc

SEQ ID NO: 15240 - DNA, 23 bp, Artificial Sequence
  Synthetic construct
gatgtccctgggccgaagcccgc

SEQ ID NO: 15241 - DNA, 23 bp, Artificial Sequence
  Synthetic construct
gagatccctgggccgaagcccgc

SEQ ID NO: 15242 - DNA, 23 bp, Artificial Sequence
  Synthetic construct
gagctccctgggccgaagcccgc

SEQ ID NO: 15243 - DNA, 23 bp, Artificial Sequence
  Synthetic construct
gagttccctgggccgaagcccgc

SEQ ID NO: 15244 - DNA, 23 bp, Artificial Sequence
  Synthetic construct
gaggaccctgggccgaagcccgc

SEQ ID NO: 15245 - DNA, 23 bp, Artificial Sequence
  Synthetic construct
gaggcccctgggccgaagcccgc

SEQ ID NO: 15246 - DNA, 23 bp, Artificial Sequence
  Synthetic construct
gagggccctgggccgaagcccgc

SEQ ID NO: 15247 - DNA, 23 bp, Artificial Sequence
  Synthetic construct
gaggtacctgggccgaagcccgc

SEQ ID NO: 15248 - DNA, 23 bp, Artificial Sequence
  Synthetic construct
gaggtgcctgggccgaagcccgc

SEQ ID NO: 15249 - DNA, 23 bp, Artificial Sequence
  Synthetic construct
gaggttcctgggccgaagcccgc

SEQ ID NO: 15250 - DNA, 23 bp, Artificial Sequence
  Synthetic construct
gaggtcactgggccgaagcccgc

SEQ ID NO: 15251 - DNA, 23 bp, Artificial Sequence
  Synthetic construct
gaggtcgctgggccgaagcccgc

SEQ ID NO: 15252 - DNA, 23 bp, Artificial Sequence
  Synthetic construct
gaggtctctgggccgaagcccgc

SEQ ID NO: 15253 - DNA, 23 bp, Artificial Sequence
  Synthetic construct
gaggtccatgggccgaagcccgc

SEQ ID NO: 15254 - DNA, 23 bp, Artificial Sequence
  Synthetic construct
gaggtccgtgggccgaagcccgc

SEQ ID NO: 15255 - DNA, 23 bp, Artificial Sequence
  Synthetic construct
gaggtccttgggccgaagcccgc

SEQ ID NO: 15256 - DNA, 23 bp, Artificial Sequence
  Synthetic construct
gaggtcccagggccgaagcccgc

SEQ ID NO: 15257 - DNA, 23 bp, Artificial Sequence
  Synthetic construct
gaggtccccgggccgaagcccgc

SEQ ID NO: 15258 - DNA, 23 bp, Artificial Sequence
  Synthetic construct
gaggtcccggggccgaagcccgc

SEQ ID NO: 15259 - DNA, 23 bp, Artificial Sequence
  Synthetic construct
gaggtccctaggccgaagcccgc

SEQ ID NO: 15260 - DNA, 23 bp, Artificial Sequence
  Synthetic construct
gaggtccctcggccgaagcccgc

SEQ ID NO: 15261 - DNA, 23 bp, Artificial Sequence
  Synthetic construct
gaggtcccttggccgaagcccgc

SEQ ID NO: 15262 - DNA, 23 bp, Artificial Sequence
  Synthetic construct
gaggtccctgagccgaagcccgc

SEQ ID NO: 15263 - DNA, 23 bp, Artificial Sequence
  Synthetic construct
gaggtccctgcgccgaagcccgc

SEQ ID NO: 15264 - DNA, 23 bp, Artificial Sequence
  Synthetic construct
gaggtccctgtgccgaagcccgc

SEQ ID NO: 15265 - DNA, 23 bp, Artificial Sequence
  Synthetic construct
gaggtccctggaccgaagcccgc

SEQ ID NO: 15266 - DNA, 23 bp, Artificial Sequence
  Synthetic construct
gaggtccctggcccgaagcccgc

SEQ ID NO: 15267 - DNA, 23 bp, Artificial Sequence
  Synthetic construct
gaggtccctggtccgaagcccgc

SEQ ID NO: 15268 - DNA, 23 bp, Artificial Sequence
  Synthetic construct
gaggtccctgggacgaagcccgc

SEQ ID NO: 15269 - DNA, 23 bp, Artificial Sequence
  Synthetic construct
gaggtccctggggcgaagcccgc

SEQ ID NO: 15270 - DNA, 23 bp, Artificial Sequence
  Synthetic construct
gaggtccctgggtcgaagcccgc

SEQ ID NO: 15271 - DNA, 23 bp, Artificial Sequence
  Synthetic construct
gaggtccctgggcagaagcccgc

SEQ ID NO: 15272 - DNA, 23 bp, Artificial Sequence
  Synthetic construct
gaggtccctgggcggaagcccgc

SEQ ID NO: 15273 - DNA, 23 bp, Artificial Sequence
  Synthetic construct
gaggtccctgggctgaagcccgc

SEQ ID NO: 15274 - DNA, 23 bp, Artificial Sequence
  Synthetic construct
gaggtccctgggccaaagcccgc

SEQ ID NO: 15275 - DNA, 23 bp, Artificial Sequence
  Synthetic construct
gaggtccctgggcccaagcccgc

SEQ ID NO: 15276 - DNA, 23 bp, Artificial Sequence
  Synthetic construct
gaggtccctgggcctaagcccgc

SEQ ID NO: 15277 - DNA, 23 bp, Artificial Sequence
  Synthetic construct
gaggtccctgggccgcagcccgc

SEQ ID NO: 15278 - DNA, 23 bp, Artificial Sequence
  Synthetic construct
gaggtccctgggccggagcccgc

SEQ ID NO: 15279 - DNA, 23 bp, Artificial Sequence
  Synthetic construct
gaggtccctgggccgtagcccgc

SEQ ID NO: 15280 - DNA, 23 bp, Artificial Sequence
  Synthetic construct
gaggtccctgggccgacgcccgc

SEQ ID NO: 15281 - DNA, 23 bp, Artificial Sequence
  Synthetic construct
gaggtccctgggccgaggcccgc

SEQ ID NO: 15282 - DNA, 23 bp, Artificial Sequence
  Synthetic construct
gaggtccctgggccgatgcccgc

SEQ ID NO: 15283 - DNA, 23 bp, Artificial Sequence
  Synthetic construct
gaggtccctgggccgaaacccgc

SEQ ID NO: 15284 - DNA, 23 bp, Artificial Sequence
  Synthetic construct
gaggtccctgggccgaaccccgc

SEQ ID NO: 15285 - DNA, 23 bp, Artificial Sequence
  Synthetic construct
gaggtccctgggccgaatcccgc

SEQ ID NO: 15286 - DNA, 23 bp, Artificial Sequence
  Synthetic construct
gaggtccctgggccgaagaccgc

SEQ ID NO: 15287 - DNA, 23 bp, Artificial Sequence
  Synthetic construct
gaggtccctgggccgaaggccgc

SEQ ID NO: 15288 - DNA, 23 bp, Artificial Sequence
  Synthetic construct
gaggtccctgggccgaagtccgc

SEQ ID NO: 15289 - DNA, 23 bp, Artificial Sequence
  Synthetic construct
gaggtccctgggccgaagcacgc

SEQ ID NO: 15290 - DNA, 23 bp, Artificial Sequence
  Synthetic construct
gaggtccctgggccgaagcgcgc

SEQ ID NO: 15291 - DNA, 23 bp, Artificial Sequence
  Synthetic construct
gaggtccctgggccgaagctcgc

SEQ ID NO: 15292 - DNA, 23 bp, Artificial Sequence
  Synthetic construct
gaggtccctgggccgaagccagc

SEQ ID NO: 15293 - DNA, 23 bp, Artificial Sequence
  Synthetic construct
gaggtccctgggccgaagccggc

SEQ ID NO: 15294 - DNA, 23 bp, Artificial Sequence
  Synthetic construct
gaggtccctgggccgaagcctgc

SEQ ID NO: 15295 - DNA, 23 bp, Artificial Sequence
  Synthetic construct
gaggtccctgggccgaagcccac

SEQ ID NO: 15296 - DNA, 23 bp, Artificial Sequence
  Synthetic construct
gaggtccctgggccgaagccccc

SEQ ID NO: 15297 - DNA, 23 bp, Artificial Sequence
  Synthetic construct
gaggtccctgggccgaagccctc

SEQ ID NO: 15298 - DNA, 23 bp, Artificial Sequence
  Synthetic construct
gaggtccctgggccgaagcccga

SEQ ID NO: 15299 - DNA, 23 bp, Artificial Sequence
  Synthetic construct
gaggtccctgggccgaagcccgg

SEQ ID NO: 15300 - DNA, 23 bp, Artificial Sequence
  Synthetic construct
gaggtccctgggccgaagcccgt

SEQ ID NO: 15301 - DNA, 22 bp, Artificial Sequence
  Synthetic construct
atcataggaagaaactcttgaa

SEQ ID NO: 15302 - DNA, 22 bp, Artificial Sequence
  Synthetic construct
gtcataggaagaaactcttgaa

SEQ ID NO: 15303 - DNA, 22 bp, Artificial Sequence
  Synthetic construct
ttcataggaagaaactcttgaa

SEQ ID NO: 15304 - DNA, 22 bp, Artificial Sequence
  Synthetic construct
cacataggaagaaactcttgaa

SEQ ID NO: 15305 - DNA, 22 bp, Artificial Sequence
  Synthetic construct
cccataggaagaaactcttgaa

SEQ ID NO: 15306 - DNA, 22 bp, Artificial Sequence
  Synthetic construct
cgcataggaagaaactcttgaa

SEQ ID NO: 15307 - DNA, 22 bp, Artificial Sequence
  Synthetic construct
ctaataggaagaaactcttgaa

SEQ ID NO: 15308 - DNA, 22 bp, Artificial Sequence
  Synthetic construct
ctgataggaagaaactcttgaa

SEQ ID NO: 15309 - DNA, 22 bp, Artificial Sequence
  Synthetic construct
cttataggaagaaactcttgaa

SEQ ID NO: 15310 - DNA, 22 bp, Artificial Sequence
  Synthetic construct
ctcctaggaagaaactcttgaa

SEQ ID NO: 15311 - DNA, 22 bp, Artificial Sequence
  Synthetic construct
ctcgtaggaagaaactcttgaa

SEQ ID NO: 15312 - DNA, 22 bp, Artificial Sequence
  Synthetic construct
ctcttaggaagaaactcttgaa

SEQ ID NO: 15313 - DNA, 22 bp, Artificial Sequence
  Synthetic construct
ctcaaaggaagaaactcttgaa

SEQ ID NO: 15314 - DNA, 22 bp, Artificial Sequence
  Synthetic construct
ctcacaggaagaaactcttgaa

SEQ ID NO: 15315 - DNA, 22 bp, Artificial Sequence
  Synthetic construct
ctcagaggaagaaactcttgaa

SEQ ID NO: 15316 - DNA, 22 bp, Artificial Sequence
  Synthetic construct
ctcatcggaagaaactcttgaa

SEQ ID NO: 15317 - DNA, 22 bp, Artificial Sequence
  Synthetic construct
ctcatgggaagaaactcttgaa

SEQ ID NO: 15318 - DNA, 22 bp, Artificial Sequence
  Synthetic construct
ctcattggaagaaactcttgaa

SEQ ID NO: 15319 - DNA, 22 bp, Artificial Sequence
  Synthetic construct
ctcataagaagaaactcttgaa

SEQ ID NO: 15320 - DNA, 22 bp, Artificial Sequence
  Synthetic construct
ctcatacgaagaaactcttgaa

SEQ ID NO: 15321 - DNA, 22 bp, Artificial Sequence
  Synthetic construct
ctcatatgaagaaactcttgaa

SEQ ID NO: 15322 - DNA, 22 bp, Artificial Sequence
  Synthetic construct
ctcatagaaagaaactcttgaa

SEQ ID NO: 15323 - DNA, 22 bp, Artificial Sequence
  Synthetic construct
ctcatagcaagaaactcttgaa

SEQ ID NO: 15324 - DNA, 22 bp, Artificial Sequence
  Synthetic construct
ctcatagtaagaaactcttgaa

SEQ ID NO: 15325 - DNA, 22 bp, Artificial Sequence
  Synthetic construct
ctcataggcagaaactcttgaa

SEQ ID NO: 15326 - DNA, 22 bp, Artificial Sequence
  Synthetic construct
ctcatagggagaaactcttgaa

SEQ ID NO: 15327 - DNA, 22 bp, Artificial Sequence
  Synthetic construct
ctcataggtagaaactcttgaa

SEQ ID NO: 15328 - DNA, 22 bp, Artificial Sequence
  Synthetic construct
ctcataggacgaaactcttgaa

SEQ ID NO: 15329 - DNA, 22 bp, Artificial Sequence
  Synthetic construct
ctcataggaggaaactcttgaa

SEQ ID NO: 15330 - DNA, 22 bp, Artificial Sequence
  Synthetic construct
ctcataggatgaaactcttgaa

SEQ ID NO: 15331 - DNA, 22 bp, Artificial Sequence
  Synthetic construct
ctcataggaaaaaactcttgaa

SEQ ID NO: 15332 - DNA, 22 bp, Artificial Sequence
  Synthetic construct
ctcataggaacaaactcttgaa

SEQ ID NO: 15333 - DNA, 22 bp, Artificial Sequence
  Synthetic construct
ctcataggaataaactcttgaa

SEQ ID NO: 15334 - DNA, 22 bp, Artificial Sequence
  Synthetic construct
ctcataggaagcaactcttgaa

SEQ ID NO: 15335 - DNA, 22 bp, Artificial Sequence
  Synthetic construct
ctcataggaaggaactcttgaa

SEQ ID NO: 15336 - DNA, 22 bp, Artificial Sequence
  Synthetic construct
ctcataggaagtaactcttgaa

SEQ ID NO: 15337 - DNA, 22 bp, Artificial Sequence
  Synthetic construct
ctcataggaagacactcttgaa

SEQ ID NO: 15338 - DNA, 22 bp, Artificial Sequence
  Synthetic construct
ctcataggaagagactcttgaa

SEQ ID NO: 15339 - DNA, 22 bp, Artificial Sequence
  Synthetic construct
ctcataggaagatactcttgaa

SEQ ID NO: 15340 - DNA, 22 bp, Artificial Sequence
  Synthetic construct
ctcataggaagaacctcttgaa

SEQ ID NO: 15341 - DNA, 22 bp, Artificial Sequence
  Synthetic construct
ctcataggaagaagctcttgaa

SEQ ID NO: 15342 - DNA, 22 bp, Artificial Sequence
  Synthetic construct
ctcataggaagaatctcttgaa

SEQ ID NO: 15343 - DNA, 22 bp, Artificial Sequence
  Synthetic construct
ctcataggaagaaaatcttgaa

SEQ ID NO: 15344 - DNA, 22 bp, Artificial Sequence
  Synthetic construct
ctcataggaagaaagtcttgaa

SEQ ID NO: 15345 - DNA, 22 bp, Artificial Sequence
  Synthetic construct
ctcataggaagaaattcttgaa

SEQ ID NO: 15346 - DNA, 22 bp, Artificial Sequence
  Synthetic construct
ctcataggaagaaacacttgaa

SEQ ID NO: 15347 - DNA, 22 bp, Artificial Sequence
  Synthetic construct
ctcataggaagaaacccttgaa

SEQ ID NO: 15348 - DNA, 22 bp, Artificial Sequence
  Synthetic construct
ctcataggaagaaacgcttgaa

SEQ ID NO: 15349 - DNA, 22 bp, Artificial Sequence
  Synthetic construct
ctcataggaagaaactattgaa

SEQ ID NO: 15350 - DNA, 22 bp, Artificial Sequence
  Synthetic construct
ctcataggaagaaactgttgaa

SEQ ID NO: 15351 - DNA, 22 bp, Artificial Sequence
  Synthetic construct
ctcataggaagaaacttttgaa

SEQ ID NO: 15352 - DNA, 22 bp, Artificial Sequence
  Synthetic construct
ctcataggaagaaactcatgaa

SEQ ID NO: 15353 - DNA, 22 bp, Artificial Sequence
  Synthetic construct
ctcataggaagaaactcctgaa

SEQ ID NO: 15354 - DNA, 22 bp, Artificial Sequence
  Synthetic construct
ctcataggaagaaactcgtgaa

SEQ ID NO: 15355 - DNA, 22 bp, Artificial Sequence
  Synthetic construct
ctcataggaagaaactctagaa

SEQ ID NO: 15356 - DNA, 22 bp, Artificial Sequence
  Synthetic construct
ctcataggaagaaactctcgaa

SEQ ID NO: 15357 - DNA, 22 bp, Artificial Sequence
  Synthetic construct
ctcataggaagaaactctggaa

SEQ ID NO: 15358 - DNA, 22 bp, Artificial Sequence
  Synthetic construct
ctcataggaagaaactcttaaa

SEQ ID NO: 15359 - DNA, 22 bp, Artificial Sequence
  Synthetic construct
ctcataggaagaaactcttcaa

SEQ ID NO: 15360 - DNA, 22 bp, Artificial Sequence
  Synthetic construct
ctcataggaagaaactctttaa

SEQ ID NO: 15361 - DNA, 22 bp, Artificial Sequence
  Synthetic construct
ctcataggaagaaactcttgca

SEQ ID NO: 15362 - DNA, 22 bp, Artificial Sequence
  Synthetic construct
ctcataggaagaaactcttgga

SEQ ID NO: 15363 - DNA, 22 bp, Artificial Sequence
  Synthetic construct
ctcataggaagaaactcttgta

SEQ ID NO: 15364 - DNA, 22 bp, Artificial Sequence
  Synthetic construct
ctcataggaagaaactcttgac

SEQ ID NO: 15365 - DNA, 22 bp, Artificial Sequence
  Synthetic construct
ctcataggaagaaactcttgag

SEQ ID NO: 15366 - DNA, 22 bp, Artificial Sequence
  Synthetic construct
ctcataggaagaaactcttgat

SEQ ID NO: 15367 - DNA, 22 bp, Artificial Sequence
  Synthetic construct
cgcaagacggaaacccgaggta

SEQ ID NO: 15368 - DNA, 22 bp, Artificial Sequence
  Synthetic construct
ggcaagacggaaacccgaggta

SEQ ID NO: 15369 - DNA, 22 bp, Artificial Sequence
  Synthetic construct
tgcaagacggaaacccgaggta

SEQ ID NO: 15370 - DNA, 22 bp, Artificial Sequence
  Synthetic construct
aacaagacggaaacccgaggta

SEQ ID NO: 15371 - DNA, 22 bp, Artificial Sequence
  Synthetic construct
accaagacggaaacccgaggta

SEQ ID NO: 15372 - DNA, 22 bp, Artificial Sequence
  Synthetic construct
atcaagacggaaacccgaggta

SEQ ID NO: 15373 - DNA, 22 bp, Artificial Sequence
  Synthetic construct
agaaagacggaaacccgaggta

SEQ ID NO: 15374 - DNA, 22 bp, Artificial Sequence
  Synthetic construct
aggaagacggaaacccgaggta

SEQ ID NO: 15375 - DNA, 22 bp, Artificial Sequence
  Synthetic construct
agtaagacggaaacccgaggta

SEQ ID NO: 15376 - DNA, 22 bp, Artificial Sequence
  Synthetic construct
agccagacggaaacccgaggta

SEQ ID NO: 15377 - DNA, 22 bp, Artificial Sequence
  Synthetic construct
agcgagacggaaacccgaggta

SEQ ID NO: 15378 - DNA, 22 bp, Artificial Sequence
  Synthetic construct
agctagacggaaacccgaggta

SEQ ID NO: 15379 - DNA, 22 bp, Artificial Sequence
  Synthetic construct
agcacgacggaaacccgaggta

SEQ ID NO: 15380 - DNA, 22 bp, Artificial Sequence
  Synthetic construct
agcaggacggaaacccgaggta

SEQ ID NO: 15381 - DNA, 22 bp, Artificial Sequence
  Synthetic construct
agcatgacggaaacccgaggta

SEQ ID NO: 15382 - DNA, 22 bp, Artificial Sequence
  Synthetic construct
agcaaaacggaaacccgaggta

SEQ ID NO: 15383 - DNA, 22 bp, Artificial Sequence
  Synthetic construct
agcaacacggaaacccgaggta

SEQ ID NO: 15384 - DNA, 22 bp, Artificial Sequence
  Synthetic construct
agcaatacggaaacccgaggta

SEQ ID NO: 15385 - DNA, 22 bp, Artificial Sequence
  Synthetic construct
agcaagccggaaacccgaggta

SEQ ID NO: 15386 - DNA, 22 bp, Artificial Sequence
  Synthetic construct
agcaaggcggaaacccgaggta

SEQ ID NO: 15387 - DNA, 22 bp, Artificial Sequence
  Synthetic construct
agcaagtcggaaacccgaggta

SEQ ID NO: 15388 - DNA, 22 bp, Artificial Sequence
  Synthetic construct
agcaagaaggaaacccgaggta

SEQ ID NO: 15389 - DNA, 22 bp, Artificial Sequence
  Synthetic construct
agcaagagggaaacccgaggta

SEQ ID NO: 15390 - DNA, 22 bp, Artificial Sequence
  Synthetic construct
agcaagatggaaacccgaggta

SEQ ID NO: 15391 - DNA, 22 bp, Artificial Sequence
  Synthetic construct
agcaagacagaaacccgaggta

SEQ ID NO: 15392 - DNA, 22 bp, Artificial Sequence
  Synthetic construct
agcaagaccgaaacccgaggta

SEQ ID NO: 15393 - DNA, 22 bp, Artificial Sequence
  Synthetic construct
agcaagactgaaacccgaggta

SEQ ID NO: 15394 - DNA, 22 bp, Artificial Sequence
  Synthetic construct
agcaagacgaaaacccgaggta

SEQ ID NO: 15395 - DNA, 22 bp, Artificial Sequence
  Synthetic construct
agcaagacgcaaacccgaggta

SEQ ID NO: 15396 - DNA, 22 bp, Artificial Sequence
  Synthetic construct
agcaagacgtaaacccgaggta

SEQ ID NO: 15397 - DNA, 22 bp, Artificial Sequence
  Synthetic construct
agcaagacggcaacccgaggta

SEQ ID NO: 15398 - DNA, 22 bp, Artificial Sequence
  Synthetic construct
agcaagacgggaacccgaggta

SEQ ID NO: 15399 - DNA, 22 bp, Artificial Sequence
  Synthetic construct
agcaagacggtaacccgaggta

SEQ ID NO: 15400 - DNA, 22 bp, Artificial Sequence
  Synthetic construct
agcaagacggacacccgaggta

SEQ ID NO: 15401 - DNA, 22 bp, Artificial Sequence
  Synthetic construct
agcaagacggagacccgaggta

SEQ ID NO: 15402 - DNA, 22 bp, Artificial Sequence
  Synthetic construct
agcaagacggatacccgaggta

SEQ ID NO: 15403 - DNA, 22 bp, Artificial Sequence
  Synthetic construct
agcaagacggaaccccgaggta

SEQ ID NO: 15404 - DNA, 22 bp, Artificial Sequence
  Synthetic construct
agcaagacggaagcccgaggta

SEQ ID NO: 15405 - DNA, 22 bp, Artificial Sequence
  Synthetic construct
agcaagacggaatcccgaggta

SEQ ID NO: 15406 - DNA, 22 bp, Artificial Sequence
  Synthetic construct
agcaagacggaaaaccgaggta

SEQ ID NO: 15407 - DNA, 22 bp, Artificial Sequence
  Synthetic construct
agcaagacggaaagccgaggta

SEQ ID NO: 15408 - DNA, 22 bp, Artificial Sequence
  Synthetic construct
agcaagacggaaatccgaggta

SEQ ID NO: 15409 - DNA, 22 bp, Artificial Sequence
  Synthetic construct
agcaagacggaaacacgaggta

SEQ ID NO: 15410 - DNA, 22 bp, Artificial Sequence
  Synthetic construct
agcaagacggaaacgcgaggta

SEQ ID NO: 15411 - DNA, 22 bp, Artificial Sequence
  Synthetic construct
agcaagacggaaactcgaggta

SEQ ID NO: 15412 - DNA, 22 bp, Artificial Sequence
  Synthetic construct
agcaagacggaaaccagaggta

SEQ ID NO: 15413 - DNA, 22 bp, Artificial Sequence
  Synthetic construct
agcaagacggaaaccggaggta

SEQ ID NO: 15414 - DNA, 22 bp, Artificial Sequence
  Synthetic construct
agcaagacggaaacctgaggta

SEQ ID NO: 15415 - DNA, 22 bp, Artificial Sequence
  Synthetic construct
agcaagacggaaacccaaggta

SEQ ID NO: 15416 - DNA, 22 bp, Artificial Sequence
  Synthetic construct
agcaagacggaaaccccaggta

SEQ ID NO: 15417 - DNA, 22 bp, Artificial Sequence
  Synthetic construct
agcaagacggaaaccctaggta

SEQ ID NO: 15418 - DNA, 22 bp, Artificial Sequence
  Synthetic construct
agcaagacggaaacccgcggta

SEQ ID NO: 15419 - DNA, 22 bp, Artificial Sequence
  Synthetic construct
agcaagacggaaacccggggta

SEQ ID NO: 15420 - DNA, 22 bp, Artificial Sequence
  Synthetic construct
agcaagacggaaacccgtggta

SEQ ID NO: 15421 - DNA, 22 bp, Artificial Sequence
  Synthetic construct
agcaagacggaaacccgaagta

SEQ ID NO: 15422 - DNA, 22 bp, Artificial Sequence
  Synthetic construct
agcaagacggaaacccgacgta

SEQ ID NO: 15423 - DNA, 22 bp, Artificial Sequence
  Synthetic construct
agcaagacggaaacccgatgta

SEQ ID NO: 15424 - DNA, 22 bp, Artificial Sequence
  Synthetic construct
agcaagacggaaacccgagata

SEQ ID NO: 15425 - DNA, 22 bp, Artificial Sequence
  Synthetic construct
agcaagacggaaacccgagcta

SEQ ID NO: 15426 - DNA, 22 bp, Artificial Sequence
  Synthetic construct
agcaagacggaaacccgagtta

SEQ ID NO: 15427 - DNA, 22 bp, Artificial Sequence
  Synthetic construct
agcaagacggaaacccgaggaa

SEQ ID NO: 15428 - DNA, 22 bp, Artificial Sequence
  Synthetic construct
agcaagacggaaacccgaggca

SEQ ID NO: 15429 - DNA, 22 bp, Artificial Sequence
  Synthetic construct
agcaagacggaaacccgaggga

SEQ ID NO: 15430 - DNA, 22 bp, Artificial Sequence
  Synthetic construct
agcaagacggaaacccgaggtc

SEQ ID NO: 15431 - DNA, 22 bp, Artificial Sequence
  Synthetic construct
agcaagacggaaacccgaggtg

SEQ ID NO: 15432 - DNA, 22 bp, Artificial Sequence
  Synthetic construct
agcaagacggaaacccgaggtt

SEQ ID NO: 15433 - DNA, 21 bp, Artificial Sequence
  Synthetic construct
atagagctgatccattcagcg

SEQ ID NO: 15434 - DNA, 21 bp, Artificial Sequence
  Synthetic construct
ctagagctgatccattcagcg

SEQ ID NO: 15435 - DNA, 21 bp, Artificial Sequence
  Synthetic construct
gtagagctgatccattcagcg

SEQ ID NO: 15436 - DNA, 21 bp, Artificial Sequence
  Synthetic construct
taagagctgatccattcagcg

SEQ ID NO: 15437 - DNA, 21 bp, Artificial Sequence
  Synthetic construct
tcagagctgatccattcagcg

SEQ ID NO: 15438 - DNA, 21 bp, Artificial Sequence
  Synthetic construct
tgagagctgatccattcagcg

SEQ ID NO: 15439 - DNA, 21 bp, Artificial Sequence
  Synthetic construct
ttcgagctgatccattcagcg

SEQ ID NO: 15440 - DNA, 21 bp, Artificial Sequence
  Synthetic construct
ttggagctgatccattcagcg

SEQ ID NO: 15441 - DNA, 21 bp, Artificial Sequence
  Synthetic construct
tttgagctgatccattcagcg

SEQ ID NO: 15442 - DNA, 21 bp, Artificial Sequence
  Synthetic construct
ttaaagctgatccattcagcg

SEQ ID NO: 15443 - DNA, 21 bp, Artificial Sequence
  Synthetic construct
ttacagctgatccattcagcg

SEQ ID NO: 15444 - DNA, 21 bp, Artificial Sequence
  Synthetic construct
ttatagctgatccattcagcg

SEQ ID NO: 15445 - DNA, 21 bp, Artificial Sequence
  Synthetic construct
ttagcgctgatccattcagcg

SEQ ID NO: 15446 - DNA, 21 bp, Artificial Sequence
  Synthetic construct
ttagggctgatccattcagcg

SEQ ID NO: 15447 - DNA, 21 bp, Artificial Sequence
  Synthetic construct
ttagtgctgatccattcagcg

SEQ ID NO: 15448 - DNA, 21 bp, Artificial Sequence
  Synthetic construct
ttagaactgatccattcagcg

SEQ ID NO: 15449 - DNA, 21 bp, Artificial Sequence
  Synthetic construct
ttagacctgatccattcagcg

SEQ ID NO: 15450 - DNA, 21 bp, Artificial Sequence
  Synthetic construct
ttagatctgatccattcagcg

SEQ ID NO: 15451 - DNA, 21 bp, Artificial Sequence
  Synthetic construct
ttagagatgatccattcagcg

SEQ ID NO: 15452 - DNA, 21 bp, Artificial Sequence
  Synthetic construct
ttagaggtgatccattcagcg

SEQ ID NO: 15453 - DNA, 21 bp, Artificial Sequence
  Synthetic construct
ttagagttgatccattcagcg

SEQ ID NO: 15454 - DNA, 21 bp, Artificial Sequence
  Synthetic construct
ttagagcagatccattcagcg

SEQ ID NO: 15455 - DNA, 21 bp, Artificial Sequence
  Synthetic construct
ttagagccgatccattcagcg

SEQ ID NO: 15456 - DNA, 21 bp, Artificial Sequence
  Synthetic construct
ttagagcggatccattcagcg

SEQ ID NO: 15457 - DNA, 21 bp, Artificial Sequence
  Synthetic construct
ttagagctaatccattcagcg

SEQ ID NO: 15458 - DNA, 21 bp, Artificial Sequence
  Synthetic construct
ttagagctcatccattcagcg

SEQ ID NO: 15459 - DNA, 21 bp, Artificial Sequence
  Synthetic construct
ttagagcttatccattcagcg

SEQ ID NO: 15460 - DNA, 21 bp, Artificial Sequence
  Synthetic construct
ttagagctgctccattcagcg

SEQ ID NO: 15461 - DNA, 21 bp, Artificial Sequence
  Synthetic construct
ttagagctggtccattcagcg

SEQ ID NO: 15462 - DNA, 21 bp, Artificial Sequence
  Synthetic construct
ttagagctgttccattcagcg

SEQ ID NO: 15463 - DNA, 21 bp, Artificial Sequence
  Synthetic construct
ttagagctgaaccattcagcg

SEQ ID NO: 15464 - DNA, 21 bp, Artificial Sequence
  Synthetic construct
ttagagctgacccattcagcg

SEQ ID NO: 15465 - DNA, 21 bp, Artificial Sequence
  Synthetic construct
ttagagctgagccattcagcg

SEQ ID NO: 15466 - DNA, 21 bp, Artificial Sequence
  Synthetic construct
ttagagctgatacattcagcg

SEQ ID NO: 15467 - DNA, 21 bp, Artificial Sequence
  Synthetic construct
ttagagctgatgcattcagcg

SEQ ID NO: 15468 - DNA, 21 bp, Artificial Sequence
  Synthetic construct
ttagagctgattcattcagcg

SEQ ID NO: 15469 - DNA, 21 bp, Artificial Sequence
  Synthetic construct
ttagagctgatcaattcagcg

SEQ ID NO: 15470 - DNA, 21 bp, Artificial Sequence
  Synthetic construct
ttagagctgatcgattcagcg

SEQ ID NO: 15471 - DNA, 21 bp, Artificial Sequence
  Synthetic construct
ttagagctgatctattcagcg

SEQ ID NO: 15472 - DNA, 21 bp, Artificial Sequence
  Synthetic construct
ttagagctgatcccttcagcg

SEQ ID NO: 15473 - DNA, 21 bp, Artificial Sequence
  Synthetic construct
ttagagctgatccgttcagcg

SEQ ID NO: 15474 - DNA, 21 bp, Artificial Sequence
  Synthetic construct
ttagagctgatcctttcagcg

SEQ ID NO: 15475 - DNA, 21 bp, Artificial Sequence
  Synthetic construct
ttagagctgatccaatcagcg

SEQ ID NO: 15476 - DNA, 21 bp, Artificial Sequence
  Synthetic construct
ttagagctgatccactcagcg

SEQ ID NO: 15477 - DNA, 21 bp, Artificial Sequence
  Synthetic construct
ttagagctgatccagtcagcg

SEQ ID NO: 15478 - DNA, 21 bp, Artificial Sequence
  Synthetic construct
ttagagctgatccatacagcg

SEQ ID NO: 15479 - DNA, 21 bp, Artificial Sequence
  Synthetic construct
ttagagctgatccatccagcg

SEQ ID NO: 15480 - DNA, 21 bp, Artificial Sequence
  Synthetic construct
ttagagctgatccatgcagcg

SEQ ID NO: 15481 - DNA, 21 bp, Artificial Sequence
  Synthetic construct
ttagagctgatccattaagcg

SEQ ID NO: 15482 - DNA, 21 bp, Artificial Sequence
  Synthetic construct
ttagagctgatccattgagcg

SEQ ID NO: 15483 - DNA, 21 bp, Artificial Sequence
  Synthetic construct
ttagagctgatccatttagcg

SEQ ID NO: 15484 - DNA, 21 bp, Artificial Sequence
  Synthetic construct
ttagagctgatccattccgcg

SEQ ID NO: 15485 - DNA, 21 bp, Artificial Sequence
  Synthetic construct
ttagagctgatccattcggcg

SEQ ID NO: 15486 - DNA, 21 bp, Artificial Sequence
  Synthetic construct
ttagagctgatccattctgcg

SEQ ID NO: 15487 - DNA, 21 bp, Artificial Sequence
  Synthetic construct
ttagagctgatccattcaacg

SEQ ID NO: 15488 - DNA, 21 bp, Artificial Sequence
  Synthetic construct
ttagagctgatccattcaccg

SEQ ID NO: 15489 - DNA, 21 bp, Artificial Sequence
  Synthetic construct
ttagagctgatccattcatcg

SEQ ID NO: 15490 - DNA, 21 bp, Artificial Sequence
  Synthetic construct
ttagagctgatccattcagag

SEQ ID NO: 15491 - DNA, 21 bp, Artificial Sequence
  Synthetic construct
ttagagctgatccattcaggg

SEQ ID NO: 15492 - DNA, 21 bp, Artificial Sequence
  Synthetic construct
ttagagctgatccattcagtg

SEQ ID NO: 15493 - DNA, 21 bp, Artificial Sequence
  Synthetic construct
ttagagctgatccattcagca

SEQ ID NO: 15494 - DNA, 21 bp, Artificial Sequence
  Synthetic construct
ttagagctgatccattcagcc

SEQ ID NO: 15495 - DNA, 21 bp, Artificial Sequence
  Synthetic construct
ttagagctgatccattcagct

SEQ ID NO: 15496 - DNA, 20 bp, Artificial Sequence
  Synthetic construct
cgtatggaaccacgctatgt

SEQ ID NO: 15497 - DNA, 20 bp, Artificial Sequence
  Synthetic construct
ggtatggaaccacgctatgt

SEQ ID NO: 15498 - DNA, 20 bp, Artificial Sequence
  Synthetic construct
tgtatggaaccacgctatgt

SEQ ID NO: 15499 - DNA, 20 bp, Artificial Sequence
  Synthetic construct
aatatggaaccacgctatgt

SEQ ID NO: 15500 - DNA, 20 bp, Artificial Sequence
  Synthetic construct
actatggaaccacgctatgt

SEQ ID NO: 15501 - DNA, 20 bp, Artificial Sequence
  Synthetic construct
attatggaaccacgctatgt

SEQ ID NO: 15502 - DNA, 20 bp, Artificial Sequence
  Synthetic construct
agaatggaaccacgctatgt

SEQ ID NO: 15503 - DNA, 20 bp, Artificial Sequence
  Synthetic construct
agcatggaaccacgctatgt

SEQ ID NO: 15504 - DNA, 20 bp, Artificial Sequence
  Synthetic construct
aggatggaaccacgctatgt

SEQ ID NO: 15505 - DNA, 20 bp, Artificial Sequence
  Synthetic construct
agtctggaaccacgctatgt

SEQ ID NO: 15506 - DNA, 20 bp, Artificial Sequence
  Synthetic construct
agtgtggaaccacgctatgt

SEQ ID NO: 15507 - DNA, 20 bp, Artificial Sequence
  Synthetic construct
agtttggaaccacgctatgt

SEQ ID NO: 15508 - DNA, 20 bp, Artificial Sequence
  Synthetic construct
agtaaggaaccacgctatgt

SEQ ID NO: 15509 - DNA, 20 bp, Artificial Sequence
  Synthetic construct
agtacggaaccacgctatgt

SEQ ID NO: 15510 - DNA, 20 bp, Artificial Sequence
  Synthetic construct
agtagggaaccacgctatgt

SEQ ID NO: 15511 - DNA, 20 bp, Artificial Sequence
  Synthetic construct
agtatagaaccacgctatgt

SEQ ID NO: 15512 - DNA, 20 bp, Artificial Sequence
  Synthetic construct
agtatcgaaccacgctatgt

SEQ ID NO: 15513 - DNA, 20 bp, Artificial Sequence
  Synthetic construct
agtattgaaccacgctatgt

SEQ ID NO: 15514 - DNA, 20 bp, Artificial Sequence
  Synthetic construct
agtatgaaaccacgctatgt

SEQ ID NO: 15515 - DNA, 20 bp, Artificial Sequence
  Synthetic construct
agtatgcaaccacgctatgt

SEQ ID NO: 15516 - DNA, 20 bp, Artificial Sequence
  Synthetic construct
agtatgtaaccacgctatgt

SEQ ID NO: 15517 - DNA, 20 bp, Artificial Sequence
  Synthetic construct
agtatggcaccacgctatgt

SEQ ID NO: 15518 - DNA, 20 bp, Artificial Sequence
  Synthetic construct
agtatgggaccacgctatgt

SEQ ID NO: 15519 - DNA, 20 bp, Artificial Sequence
  Synthetic construct
agtatggtaccacgctatgt

SEQ ID NO: 15520 - DNA, 20 bp, Artificial Sequence
  Synthetic construct
agtatggacccacgctatgt

SEQ ID NO: 15521 - DNA, 20 bp, Artificial Sequence
  Synthetic construct
agtatggagccacgctatgt

SEQ ID NO: 15522 - DNA, 20 bp, Artificial Sequence
  Synthetic construct
agtatggatccacgctatgt

SEQ ID NO: 15523 - DNA, 20 bp, Artificial Sequence
  Synthetic construct
agtatggaaacacgctatgt

SEQ ID NO: 15524 - DNA, 20 bp, Artificial Sequence
  Synthetic construct
agtatggaagcacgctatgt

SEQ ID NO: 15525 - DNA, 20 bp, Artificial Sequence
  Synthetic construct
agtatggaatcacgctatgt

SEQ ID NO: 15526 - DNA, 20 bp, Artificial Sequence
  Synthetic construct
agtatggaacaacgctatgt

SEQ ID NO: 15527 - DNA, 20 bp, Artificial Sequence
  Synthetic construct
agtatggaacgacgctatgt

SEQ ID NO: 15528 - DNA, 20 bp, Artificial Sequence
  Synthetic construct
agtatggaactacgctatgt

SEQ ID NO: 15529 - DNA, 20 bp, Artificial Sequence
  Synthetic construct
agtatggaaccccgctatgt

SEQ ID NO: 15530 - DNA, 20 bp, Artificial Sequence
  Synthetic construct
agtatggaaccgcgctatgt

SEQ ID NO: 15531 - DNA, 20 bp, Artificial Sequence
  Synthetic construct
agtatggaacctcgctatgt

SEQ ID NO: 15532 - DNA, 20 bp, Artificial Sequence
  Synthetic construct
agtatggaaccaagctatgt

SEQ ID NO: 15533 - DNA, 20 bp, Artificial Sequence
  Synthetic construct
agtatggaaccaggctatgt

SEQ ID NO: 15534 - DNA, 20 bp, Artificial Sequence
  Synthetic construct
agtatggaaccatgctatgt

SEQ ID NO: 15535 - DNA, 20 bp, Artificial Sequence
  Synthetic construct
agtatggaaccacactatgt

SEQ ID NO: 15536 - DNA, 20 bp, Artificial Sequence
  Synthetic construct
agtatggaaccaccctatgt

SEQ ID NO: 15537 - DNA, 20 bp, Artificial Sequence
  Synthetic construct
agtatggaaccactctatgt

SEQ ID NO: 15538 - DNA, 20 bp, Artificial Sequence
  Synthetic construct
agtatggaaccacgatatgt

SEQ ID NO: 15539 - DNA, 20 bp, Artificial Sequence
  Synthetic construct
agtatggaaccacggtatgt

SEQ ID NO: 15540 - DNA, 20 bp, Artificial Sequence
  Synthetic construct
agtatggaaccacgttatgt

SEQ ID NO: 15541 - DNA, 20 bp, Artificial Sequence
  Synthetic construct
agtatggaaccacgcaatgt

SEQ ID NO: 15542 - DNA, 20 bp, Artificial Sequence
  Synthetic construct
agtatggaaccacgccatgt

SEQ ID NO: 15543 - DNA, 20 bp, Artificial Sequence
  Synthetic construct
agtatggaaccacgcgatgt

SEQ ID NO: 15544 - DNA, 20 bp, Artificial Sequence
  Synthetic construct
agtatggaaccacgctctgt

SEQ ID NO: 15545 - DNA, 20 bp, Artificial Sequence
  Synthetic construct
agtatggaaccacgctgtgt

SEQ ID NO: 15546 - DNA, 20 bp, Artificial Sequence
  Synthetic construct
agtatggaaccacgctttgt

SEQ ID NO: 15547 - DNA, 20 bp, Artificial Sequence
  Synthetic construct
agtatggaaccacgctaagt

SEQ ID NO: 15548 - DNA, 20 bp, Artificial Sequence
  Synthetic construct
agtatggaaccacgctacgt

SEQ ID NO: 15549 - DNA, 20 bp, Artificial Sequence
  Synthetic construct
agtatggaaccacgctaggt

SEQ ID NO: 15550 - DNA, 20 bp, Artificial Sequence
  Synthetic construct
agtatggaaccacgctatat

SEQ ID NO: 15551 - DNA, 20 bp, Artificial Sequence
  Synthetic construct
agtatggaaccacgctatct

SEQ ID NO: 15552 - DNA, 20 bp, Artificial Sequence
  Synthetic construct
agtatggaaccacgctattt

SEQ ID NO: 15553 - DNA, 20 bp, Artificial Sequence
  Synthetic construct
agtatggaaccacgctatga

SEQ ID NO: 15554 - DNA, 20 bp, Artificial Sequence
  Synthetic construct
agtatggaaccacgctatgc

SEQ ID NO: 15555 - DNA, 20 bp, Artificial Sequence
  Synthetic construct
agtatggaaccacgctatgg

SEQ ID NO: 15556 - DNA, 22 bp, Artificial Sequence
  Synthetic construct
ccggatgctggtttgtaaaaca

SEQ ID NO: 15557 - DNA, 22 bp, Artificial Sequence
  Synthetic construct
gcggatgctggtttgtaaaaca

SEQ ID NO: 15558 - DNA, 22 bp, Artificial Sequence
  Synthetic construct
tcggatgctggtttgtaaaaca

SEQ ID NO: 15559 - DNA, 22 bp, Artificial Sequence
  Synthetic construct
aaggatgctggtttgtaaaaca

SEQ ID NO: 15560 - DNA, 22 bp, Artificial Sequence
  Synthetic construct
agggatgctggtttgtaaaaca

SEQ ID NO: 15561 - DNA, 22 bp, Artificial Sequence
  Synthetic construct
atggatgctggtttgtaaaaca

SEQ ID NO: 15562 - DNA, 22 bp, Artificial Sequence
  Synthetic construct
acagatgctggtttgtaaaaca

SEQ ID NO: 15563 - DNA, 22 bp, Artificial Sequence
  Synthetic construct
accgatgctggtttgtaaaaca

SEQ ID NO: 15564 - DNA, 22 bp, Artificial Sequence
  Synthetic construct
actgatgctggtttgtaaaaca

SEQ ID NO: 15565 - DNA, 22 bp, Artificial Sequence
  Synthetic construct
acgaatgctggtttgtaaaaca

SEQ ID NO: 15566 - DNA, 22 bp, Artificial Sequence
  Synthetic construct
acgcatgctggtttgtaaaaca

SEQ ID NO: 15567 - DNA, 22 bp, Artificial Sequence
  Synthetic construct
acgtatgctggtttgtaaaaca

SEQ ID NO: 15568 - DNA, 22 bp, Artificial Sequence
  Synthetic construct
acggctgctggtttgtaaaaca

SEQ ID NO: 15569 - DNA, 22 bp, Artificial Sequence
  Synthetic construct
acgggtgctggtttgtaaaaca

SEQ ID NO: 15570 - DNA, 22 bp, Artificial Sequence
  Synthetic construct
acggttgctggtttgtaaaaca

SEQ ID NO: 15571 - DNA, 22 bp, Artificial Sequence
  Synthetic construct
acggaagctggtttgtaaaaca

SEQ ID NO: 15572 - DNA, 22 bp, Artificial Sequence
  Synthetic construct
acggacgctggtttgtaaaaca

SEQ ID NO: 15573 - DNA, 22 bp, Artificial Sequence
  Synthetic construct
acggaggctggtttgtaaaaca

SEQ ID NO: 15574 - DNA, 22 bp, Artificial Sequence
  Synthetic construct
acggatactggtttgtaaaaca

SEQ ID NO: 15575 - DNA, 22 bp, Artificial Sequence
  Synthetic construct
acggatcctggtttgtaaaaca

SEQ ID NO: 15576 - DNA, 22 bp, Artificial Sequence
  Synthetic construct
acggattctggtttgtaaaaca

SEQ ID NO: 15577 - DNA, 22 bp, Artificial Sequence
  Synthetic construct
acggatgatggtttgtaaaaca

SEQ ID NO: 15578 - DNA, 22 bp, Artificial Sequence
  Synthetic construct
acggatggtggtttgtaaaaca

SEQ ID NO: 15579 - DNA, 22 bp, Artificial Sequence
  Synthetic construct
acggatgttggtttgtaaaaca

SEQ ID NO: 15580 - DNA, 22 bp, Artificial Sequence
  Synthetic construct
acggatgcaggtttgtaaaaca

SEQ ID NO: 15581 - DNA, 22 bp, Artificial Sequence
  Synthetic construct
acggatgccggtttgtaaaaca

SEQ ID NO: 15582 - DNA, 22 bp, Artificial Sequence
  Synthetic construct
acggatgcgggtttgtaaaaca

SEQ ID NO: 15583 - DNA, 22 bp, Artificial Sequence
  Synthetic construct
acggatgctagtttgtaaaaca

SEQ ID NO: 15584 - DNA, 22 bp, Artificial Sequence
  Synthetic construct
acggatgctcgtttgtaaaaca

SEQ ID NO: 15585 - DNA, 22 bp, Artificial Sequence
  Synthetic construct
acggatgcttgtttgtaaaaca

SEQ ID NO: 15586 - DNA, 22 bp, Artificial Sequence
  Synthetic construct
acggatgctgatttgtaaaaca

SEQ ID NO: 15587 - DNA, 22 bp, Artificial Sequence
  Synthetic construct
acggatgctgctttgtaaaaca

SEQ ID NO: 15588 - DNA, 22 bp, Artificial Sequence
  Synthetic construct
acggatgctgttttgtaaaaca

SEQ ID NO: 15589 - DNA, 22 bp, Artificial Sequence
  Synthetic construct
acggatgctggattgtaaaaca

SEQ ID NO: 15590 - DNA, 22 bp, Artificial Sequence
  Synthetic construct
acggatgctggcttgtaaaaca

SEQ ID NO: 15591 - DNA, 22 bp, Artificial Sequence
  Synthetic construct
acggatgctgggttgtaaaaca

SEQ ID NO: 15592 - DNA, 22 bp, Artificial Sequence
  Synthetic construct
acggatgctggtatgtaaaaca

SEQ ID NO: 15593 - DNA, 22 bp, Artificial Sequence
  Synthetic construct
acggatgctggtctgtaaaaca

SEQ ID NO: 15594 - DNA, 22 bp, Artificial Sequence
  Synthetic construct
acggatgctggtgtgtaaaaca

SEQ ID NO: 15595 - DNA, 22 bp, Artificial Sequence
  Synthetic construct
acggatgctggttagtaaaaca

SEQ ID NO: 15596 - DNA, 22 bp, Artificial Sequence
  Synthetic construct
acggatgctggttcgtaaaaca

SEQ ID NO: 15597 - DNA, 22 bp, Artificial Sequence
  Synthetic construct
acggatgctggttggtaaaaca

SEQ ID NO: 15598 - DNA, 22 bp, Artificial Sequence
  Synthetic construct
acggatgctggtttataaaaca

SEQ ID NO: 15599 - DNA, 22 bp, Artificial Sequence
  Synthetic construct
acggatgctggtttctaaaaca

SEQ ID NO: 15600 - DNA, 22 bp, Artificial Sequence
  Synthetic construct
acggatgctggtttttaaaaca

SEQ ID NO: 15601 - DNA, 22 bp, Artificial Sequence
  Synthetic construct
acggatgctggtttgaaaaaca

SEQ ID NO: 15602 - DNA, 22 bp, Artificial Sequence
  Synthetic construct
acggatgctggtttgcaaaaca

SEQ ID NO: 15603 - DNA, 22 bp, Artificial Sequence
  Synthetic construct
acggatgctggtttggaaaaca

SEQ ID NO: 15604 - DNA, 22 bp, Artificial Sequence
  Synthetic construct
acggatgctggtttgtcaaaca

SEQ ID NO: 15605 - DNA, 22 bp, Artificial Sequence
  Synthetic construct
acggatgctggtttgtgaaaca

SEQ ID NO: 15606 - DNA, 22 bp, Artificial Sequence
  Synthetic construct
acggatgctggtttgttaaaca

SEQ ID NO: 15607 - DNA, 22 bp, Artificial Sequence
  Synthetic construct
acggatgctggtttgtacaaca

SEQ ID NO: 15608 - DNA, 22 bp, Artificial Sequence
  Synthetic construct
acggatgctggtttgtagaaca

SEQ ID NO: 15609 - DNA, 22 bp, Artificial Sequence
  Synthetic construct
acggatgctggtttgtataaca

SEQ ID NO: 15610 - DNA, 22 bp, Artificial Sequence
  Synthetic construct
acggatgctggtttgtaacaca

SEQ ID NO: 15611 - DNA, 22 bp, Artificial Sequence
  Synthetic construct
acggatgctggtttgtaagaca

SEQ ID NO: 15612 - DNA, 22 bp, Artificial Sequence
  Synthetic construct
acggatgctggtttgtaataca

SEQ ID NO: 15613 - DNA, 22 bp, Artificial Sequence
  Synthetic construct
acggatgctggtttgtaaacca

SEQ ID NO: 15614 - DNA, 22 bp, Artificial Sequence
  Synthetic construct
acggatgctggtttgtaaagca

SEQ ID NO: 15615 - DNA, 22 bp, Artificial Sequence
  Synthetic construct
acggatgctggtttgtaaatca

SEQ ID NO: 15616 - DNA, 22 bp, Artificial Sequence
  Synthetic construct
acggatgctggtttgtaaaaaa

SEQ ID NO: 15617 - DNA, 22 bp, Artificial Sequence
  Synthetic construct
acggatgctggtttgtaaaaga

SEQ ID NO: 15618 - DNA, 22 bp, Artificial Sequence
  Synthetic construct
acggatgctggtttgtaaaata

SEQ ID NO: 15619 - DNA, 22 bp, Artificial Sequence
  Synthetic construct
acggatgctggtttgtaaaacc

SEQ ID NO: 15620 - DNA, 22 bp, Artificial Sequence
  Synthetic construct
acggatgctggtttgtaaaacg

SEQ ID NO: 15621 - DNA, 22 bp, Artificial Sequence
  Synthetic construct
acggatgctggtttgtaaaact

SEQ ID NO: 15622 - DNA, 21 bp, Artificial Sequence
  Synthetic construct
actaacgcatctaaggtatgg

SEQ ID NO: 15623 - DNA, 21 bp, Artificial Sequence
  Synthetic construct
cctaacgcatctaaggtatgg

SEQ ID NO: 15624 - DNA, 21 bp, Artificial Sequence
  Synthetic construct
tctaacgcatctaaggtatgg

SEQ ID NO: 15625 - DNA, 21 bp, Artificial Sequence
  Synthetic construct
gataacgcatctaaggtatgg

SEQ ID NO: 15626 - DNA, 21 bp, Artificial Sequence
  Synthetic construct
ggtaacgcatctaaggtatgg

SEQ ID NO: 15627 - DNA, 21 bp, Artificial Sequence
  Synthetic construct
gttaacgcatctaaggtatgg

SEQ ID NO: 15628 - DNA, 21 bp, Artificial Sequence
  Synthetic construct
gcaaacgcatctaaggtatgg

SEQ ID NO: 15629 - DNA, 21 bp, Artificial Sequence
  Synthetic construct
gccaacgcatctaaggtatgg

SEQ ID NO: 15630 - DNA, 21 bp, Artificial Sequence
  Synthetic construct
gcgaacgcatctaaggtatgg

SEQ ID NO: 15631 - DNA, 21 bp, Artificial Sequence
  Synthetic construct
gctcacgcatctaaggtatgg

SEQ ID NO: 15632 - DNA, 21 bp, Artificial Sequence
  Synthetic construct
gctgacgcatctaaggtatgg

SEQ ID NO: 15633 - DNA, 21 bp, Artificial Sequence
  Synthetic construct
gcttacgcatctaaggtatgg

SEQ ID NO: 15634 - DNA, 21 bp, Artificial Sequence
  Synthetic construct
gctaccgcatctaaggtatgg

SEQ ID NO: 15635 - DNA, 21 bp, Artificial Sequence
  Synthetic construct
gctagcgcatctaaggtatgg

SEQ ID NO: 15636 - DNA, 21 bp, Artificial Sequence
  Synthetic construct
gctatcgcatctaaggtatgg

SEQ ID NO: 15637 - DNA, 21 bp, Artificial Sequence
  Synthetic construct
gctaaagcatctaaggtatgg

SEQ ID NO: 15638 - DNA, 21 bp, Artificial Sequence
  Synthetic construct
gctaaggcatctaaggtatgg

SEQ ID NO: 15639 - DNA, 21 bp, Artificial Sequence
  Synthetic construct
gctaatgcatctaaggtatgg

SEQ ID NO: 15640 - DNA, 21 bp, Artificial Sequence
  Synthetic construct
gctaacacatctaaggtatgg

SEQ ID NO: 15641 - DNA, 21 bp, Artificial Sequence
  Synthetic construct
gctaacccatctaaggtatgg

SEQ ID NO: 15642 - DNA, 21 bp, Artificial Sequence
  Synthetic construct
gctaactcatctaaggtatgg

SEQ ID NO: 15643 - DNA, 21 bp, Artificial Sequence
  Synthetic construct
gctaacgaatctaaggtatgg

SEQ ID NO: 15644 - DNA, 21 bp, Artificial Sequence
  Synthetic construct
gctaacggatctaaggtatgg

SEQ ID NO: 15645 - DNA, 21 bp, Artificial Sequence
  Synthetic construct
gctaacgtatctaaggtatgg

SEQ ID NO: 15646 - DNA, 21 bp, Artificial Sequence
  Synthetic construct
gctaacgcctctaaggtatgg

SEQ ID NO: 15647 - DNA, 21 bp, Artificial Sequence
  Synthetic construct
gctaacgcgtctaaggtatgg

SEQ ID NO: 15648 - DNA, 21 bp, Artificial Sequence
  Synthetic construct
gctaacgcttctaaggtatgg

SEQ ID NO: 15649 - DNA, 21 bp, Artificial Sequence
  Synthetic construct
gctaacgcaactaaggtatgg

SEQ ID NO: 15650 - DNA, 21 bp, Artificial Sequence
  Synthetic construct
gctaacgcacctaaggtatgg

SEQ ID NO: 15651 - DNA, 21 bp, Artificial Sequence
  Synthetic construct
gctaacgcagctaaggtatgg

SEQ ID NO: 15652 - DNA, 21 bp, Artificial Sequence
  Synthetic construct
gctaacgcatataaggtatgg

SEQ ID NO: 15653 - DNA, 21 bp, Artificial Sequence
  Synthetic construct
gctaacgcatgtaaggtatgg

SEQ ID NO: 15654 - DNA, 21 bp, Artificial Sequence
  Synthetic construct
gctaacgcatttaaggtatgg

SEQ ID NO: 15655 - DNA, 21 bp, Artificial Sequence
  Synthetic construct
gctaacgcatcaaaggtatgg

SEQ ID NO: 15656 - DNA, 21 bp, Artificial Sequence
  Synthetic construct
gctaacgcatccaaggtatgg

SEQ ID NO: 15657 - DNA, 21 bp, Artificial Sequence
  Synthetic construct
gctaacgcatcgaaggtatgg

SEQ ID NO: 15658 - DNA, 21 bp, Artificial Sequence
  Synthetic construct
gctaacgcatctcaggtatgg

SEQ ID NO: 15659 - DNA, 21 bp, Artificial Sequence
  Synthetic construct
gctaacgcatctgaggtatgg

SEQ ID NO: 15660 - DNA, 21 bp, Artificial Sequence
  Synthetic construct
gctaacgcatcttaggtatgg

SEQ ID NO: 15661 - DNA, 21 bp, Artificial Sequence
  Synthetic construct
gctaacgcatctacggtatgg

SEQ ID NO: 15662 - DNA, 21 bp, Artificial Sequence
  Synthetic construct
gctaacgcatctagggtatgg

SEQ ID NO: 15663 - DNA, 21 bp, Artificial Sequence
  Synthetic construct
gctaacgcatctatggtatgg

SEQ ID NO: 15664 - DNA, 21 bp, Artificial Sequence
  Synthetic construct
gctaacgcatctaaagtatgg

SEQ ID NO: 15665 - DNA, 21 bp, Artificial Sequence
  Synthetic construct
gctaacgcatctaacgtatgg

SEQ ID NO: 15666 - DNA, 21 bp, Artificial Sequence
  Synthetic construct
gctaacgcatctaatgtatgg

SEQ ID NO: 15667 - DNA, 21 bp, Artificial Sequence
  Synthetic construct
gctaacgcatctaagatatgg

SEQ ID NO: 15668 - DNA, 21 bp, Artificial Sequence
  Synthetic construct
gctaacgcatctaagctatgg

SEQ ID NO: 15669 - DNA, 21 bp, Artificial Sequence
  Synthetic construct
gctaacgcatctaagttatgg

SEQ ID NO: 15670 - DNA, 21 bp, Artificial Sequence
  Synthetic construct
gctaacgcatctaaggaatgg

SEQ ID NO: 15671 - DNA, 21 bp, Artificial Sequence
  Synthetic construct
gctaacgcatctaaggcatgg

SEQ ID NO: 15672 - DNA, 21 bp, Artificial Sequence
  Synthetic construct
gctaacgcatctaagggatgg

SEQ ID NO: 15673 - DNA, 21 bp, Artificial Sequence
  Synthetic construct
gctaacgcatctaaggtctgg

SEQ ID NO: 15674 - DNA, 21 bp, Artificial Sequence
  Synthetic construct
gctaacgcatctaaggtgtgg

SEQ ID NO: 15675 - DNA, 21 bp, Artificial Sequence
  Synthetic construct
gctaacgcatctaaggtttgg

SEQ ID NO: 15676 - DNA, 21 bp, Artificial Sequence
  Synthetic construct
gctaacgcatctaaggtaagg

SEQ ID NO: 15677 - DNA, 21 bp, Artificial Sequence
  Synthetic construct
gctaacgcatctaaggtacgg

SEQ ID NO: 15678 - DNA, 21 bp, Artificial Sequence
  Synthetic construct
gctaacgcatctaaggtaggg

SEQ ID NO: 15679 - DNA, 21 bp, Artificial Sequence
  Synthetic construct
gctaacgcatctaaggtatag

SEQ ID NO: 15680 - DNA, 21 bp, Artificial Sequence
  Synthetic construct
gctaacgcatctaaggtatcg

SEQ ID NO: 15681 - DNA, 21 bp, Artificial Sequence
  Synthetic construct
gctaacgcatctaaggtattg

SEQ ID NO: 15682 - DNA, 21 bp, Artificial Sequence
  Synthetic construct
gctaacgcatctaaggtatga

SEQ ID NO: 15683 - DNA, 21 bp, Artificial Sequence
  Synthetic construct
gctaacgcatctaaggtatgc

SEQ ID NO: 15684 - DNA, 21 bp, Artificial Sequence
  Synthetic construct
gctaacgcatctaaggtatgt

SEQ ID NO: 15685 - DNA, 21 bp, Artificial Sequence
  Synthetic construct
ccggttgcttgttcagcgaac

SEQ ID NO: 15686 - DNA, 21 bp, Artificial Sequence
  Synthetic construct
gcggttgcttgttcagcgaac

SEQ ID NO: 15687 - DNA, 21 bp, Artificial Sequence
  Synthetic construct
tcggttgcttgttcagcgaac

SEQ ID NO: 15688 - DNA, 21 bp, Artificial Sequence
  Synthetic construct
aaggttgcttgttcagcgaac

SEQ ID NO: 15689 - DNA, 21 bp, Artificial Sequence
  Synthetic construct
agggttgcttgttcagcgaac

SEQ ID NO: 15690 - DNA, 21 bp, Artificial Sequence
  Synthetic construct
atggttgcttgttcagcgaac

SEQ ID NO: 15691 - DNA, 21 bp, Artificial Sequence
  Synthetic construct
acagttgcttgttcagcgaac

SEQ ID NO: 15692 - DNA, 21 bp, Artificial Sequence
  Synthetic construct
accgttgcttgttcagcgaac

SEQ ID NO: 15693 - DNA, 21 bp, Artificial Sequence
  Synthetic construct
actgttgcttgttcagcgaac

SEQ ID NO: 15694 - DNA, 21 bp, Artificial Sequence
  Synthetic construct
acgattgcttgttcagcgaac

SEQ ID NO: 15695 - DNA, 21 bp, Artificial Sequence
  Synthetic construct
acgcttgcttgttcagcgaac

SEQ ID NO: 15696 - DNA, 21 bp, Artificial Sequence
  Synthetic construct
acgtttgcttgttcagcgaac

SEQ ID NO: 15697 - DNA, 21 bp, Artificial Sequence
  Synthetic construct
acggatgcttgttcagcgaac

SEQ ID NO: 15698 - DNA, 21 bp, Artificial Sequence
  Synthetic construct
acggctgcttgttcagcgaac

SEQ ID NO: 15699 - DNA, 21 bp, Artificial Sequence
  Synthetic construct
acgggtgcttgttcagcgaac

SEQ ID NO: 15700 - DNA, 21 bp, Artificial Sequence
  Synthetic construct
acggtagcttgttcagcgaac

SEQ ID NO: 15701 - DNA, 21 bp, Artificial Sequence
  Synthetic construct
acggtcgcttgttcagcgaac

SEQ ID NO: 15702 - DNA, 21 bp, Artificial Sequence
  Synthetic construct
acggtggcttgttcagcgaac

SEQ ID NO: 15703 - DNA, 21 bp, Artificial Sequence
  Synthetic construct
acggttacttgttcagcgaac

SEQ ID NO: 15704 - DNA, 21 bp, Artificial Sequence
  Synthetic construct
acggttccttgttcagcgaac

SEQ ID NO: 15705 - DNA, 21 bp, Artificial Sequence
  Synthetic construct
acggtttcttgttcagcgaac

SEQ ID NO: 15706 - DNA, 21 bp, Artificial Sequence
  Synthetic construct
acggttgattgttcagcgaac

SEQ ID NO: 15707 - DNA, 21 bp, Artificial Sequence
  Synthetic construct
acggttggttgttcagcgaac

SEQ ID NO: 15708 - DNA, 21 bp, Artificial Sequence
  Synthetic construct
acggttgtttgttcagcgaac

SEQ ID NO: 15709 - DNA, 21 bp, Artificial Sequence
  Synthetic construct
acggttgcatgttcagcgaac

SEQ ID NO: 15710 - DNA, 21 bp, Artificial Sequence
  Synthetic construct
acggttgcctgttcagcgaac

SEQ ID NO: 15711 - DNA, 21 bp, Artificial Sequence
  Synthetic construct
acggttgcgtgttcagcgaac

SEQ ID NO: 15712 - DNA, 21 bp, Artificial Sequence
  Synthetic construct
acggttgctagttcagcgaac

SEQ ID NO: 15713 - DNA, 21 bp, Artificial Sequence
  Synthetic construct
acggttgctcgttcagcgaac

SEQ ID NO: 15714 - DNA, 21 bp, Artificial Sequence
  Synthetic construct
acggttgctggttcagcgaac

SEQ ID NO: 15715 - DNA, 21 bp, Artificial Sequence
  Synthetic construct
acggttgcttattcagcgaac

SEQ ID NO: 15716 - DNA, 21 bp, Artificial Sequence
  Synthetic construct
acggttgcttcttcagcgaac

SEQ ID NO: 15717 - DNA, 21 bp, Artificial Sequence
  Synthetic construct
acggttgctttttcagcgaac

SEQ ID NO: 15718 - DNA, 21 bp, Artificial Sequence
  Synthetic construct
acggttgcttgatcagcgaac

SEQ ID NO: 15719 - DNA, 21 bp, Artificial Sequence
  Synthetic construct
acggttgcttgctcagcgaac

SEQ ID NO: 15720 - DNA, 21 bp, Artificial Sequence
  Synthetic construct
acggttgcttggtcagcgaac

SEQ ID NO: 15721 - DNA, 21 bp, Artificial Sequence
  Synthetic construct
acggttgcttgtacagcgaac

SEQ ID NO: 15722 - DNA, 21 bp, Artificial Sequence
  Synthetic construct
acggttgcttgtccagcgaac

SEQ ID NO: 15723 - DNA, 21 bp, Artificial Sequence
  Synthetic construct
acggttgcttgtgcagcgaac

SEQ ID NO: 15724 - DNA, 21 bp, Artificial Sequence
  Synthetic construct
acggttgcttgttaagcgaac

SEQ ID NO: 15725 - DNA, 21 bp, Artificial Sequence
  Synthetic construct
acggttgcttgttgagcgaac

SEQ ID NO: 15726 - DNA, 21 bp, Artificial Sequence
  Synthetic construct
acggttgcttgtttagcgaac

SEQ ID NO: 15727 - DNA, 21 bp, Artificial Sequence
  Synthetic construct
acggttgcttgttccgcgaac

SEQ ID NO: 15728 - DNA, 21 bp, Artificial Sequence
  Synthetic construct
acggttgcttgttcggcgaac

SEQ ID NO: 15729 - DNA, 21 bp, Artificial Sequence
  Synthetic construct
acggttgcttgttctgcgaac

SEQ ID NO: 15730 - DNA, 21 bp, Artificial Sequence
  Synthetic construct
acggttgcttgttcaacgaac

SEQ ID NO: 15731 - DNA, 21 bp, Artificial Sequence
  Synthetic construct
acggttgcttgttcaccgaac

SEQ ID NO: 15732 - DNA, 21 bp, Artificial Sequence
  Synthetic construct
acggttgcttgttcatcgaac

SEQ ID NO: 15733 - DNA, 21 bp, Artificial Sequence
  Synthetic construct
acggttgcttgttcagagaac

SEQ ID NO: 15734 - DNA, 21 bp, Artificial Sequence
  Synthetic construct
acggttgcttgttcagggaac

SEQ ID NO: 15735 - DNA, 21 bp, Artificial Sequence
  Synthetic construct
acggttgcttgttcagtgaac

SEQ ID NO: 15736 - DNA, 21 bp, Artificial Sequence
  Synthetic construct
acggttgcttgttcagcaaac

SEQ ID NO: 15737 - DNA, 21 bp, Artificial Sequence
  Synthetic construct
acggttgcttgttcagccaac

SEQ ID NO: 15738 - DNA, 21 bp, Artificial Sequence
  Synthetic construct
acggttgcttgttcagctaac

SEQ ID NO: 15739 - DNA, 21 bp, Artificial Sequence
  Synthetic construct
acggttgcttgttcagcgcac

SEQ ID NO: 15740 - DNA, 21 bp, Artificial Sequence
  Synthetic construct
acggttgcttgttcagcggac

SEQ ID NO: 15741 - DNA, 21 bp, Artificial Sequence
  Synthetic construct
acggttgcttgttcagcgtac

SEQ ID NO: 15742 - DNA, 21 bp, Artificial Sequence
  Synthetic construct
acggttgcttgttcagcgacc

SEQ ID NO: 15743 - DNA, 21 bp, Artificial Sequence
  Synthetic construct
acggttgcttgttcagcgagc

SEQ ID NO: 15744 - DNA, 21 bp, Artificial Sequence
  Synthetic construct
acggttgcttgttcagcgatc

SEQ ID NO: 15745 - DNA, 21 bp, Artificial Sequence
  Synthetic construct
acggttgcttgttcagcgaaa

SEQ ID NO: 15746 - DNA, 21 bp, Artificial Sequence
  Synthetic construct
acggttgcttgttcagcgaag

SEQ ID NO: 15747 - DNA, 21 bp, Artificial Sequence
  Synthetic construct
acggttgcttgttcagcgaat

SEQ ID NO: 15748 - DNA, 20 bp, Artificial Sequence
  Synthetic construct
actgccggccacgtgttttg

SEQ ID NO: 15749 - DNA, 20 bp, Artificial Sequence
  Synthetic construct
gctgccggccacgtgttttg

SEQ ID NO: 15750 - DNA, 20 bp, Artificial Sequence
  Synthetic construct
tctgccggccacgtgttttg

SEQ ID NO: 15751 - DNA, 20 bp, Artificial Sequence
  Synthetic construct
catgccggccacgtgttttg

SEQ ID NO: 15752 - DNA, 20 bp, Artificial Sequence
  Synthetic construct
cgtgccggccacgtgttttg

SEQ ID NO: 15753 - DNA, 20 bp, Artificial Sequence
  Synthetic construct
cttgccggccacgtgttttg

SEQ ID NO: 15754 - DNA, 20 bp, Artificial Sequence
  Synthetic construct
ccagccggccacgtgttttg

SEQ ID NO: 15755 - DNA, 20 bp, Artificial Sequence
  Synthetic construct
cccgccggccacgtgttttg

SEQ ID NO: 15756 - DNA, 20 bp, Artificial Sequence
  Synthetic construct
ccggccggccacgtgttttg

SEQ ID NO: 15757 - DNA, 20 bp, Artificial Sequence
  Synthetic construct
cctaccggccacgtgttttg

SEQ ID NO: 15758 - DNA, 20 bp, Artificial Sequence
  Synthetic construct
cctcccggccacgtgttttg

SEQ ID NO: 15759 - DNA, 20 bp, Artificial Sequence
  Synthetic construct
ccttccggccacgtgttttg

SEQ ID NO: 15760 - DNA, 20 bp, Artificial Sequence
  Synthetic construct
cctgacggccacgtgttttg

SEQ ID NO: 15761 - DNA, 20 bp, Artificial Sequence
  Synthetic construct
cctggcggccacgtgttttg

SEQ ID NO: 15762 - DNA, 20 bp, Artificial Sequence
  Synthetic construct
cctgtcggccacgtgttttg

SEQ ID NO: 15763 - DNA, 20 bp, Artificial Sequence
  Synthetic construct
cctgcaggccacgtgttttg

SEQ ID NO: 15764 - DNA, 20 bp, Artificial Sequence
  Synthetic construct
cctgcgggccacgtgttttg

SEQ ID NO: 15765 - DNA, 20 bp, Artificial Sequence
  Synthetic construct
cctgctggccacgtgttttg

SEQ ID NO: 15766 - DNA, 20 bp, Artificial Sequence
  Synthetic construct
cctgccagccacgtgttttg

SEQ ID NO: 15767 - DNA, 20 bp, Artificial Sequence
  Synthetic construct
cctgcccgccacgtgttttg

SEQ ID NO: 15768 - DNA, 20 bp, Artificial Sequence
  Synthetic construct
cctgcctgccacgtgttttg

SEQ ID NO: 15769 - DNA, 20 bp, Artificial Sequence
  Synthetic construct
cctgccgaccacgtgttttg

SEQ ID NO: 15770 - DNA, 20 bp, Artificial Sequence
  Synthetic construct
cctgccgcccacgtgttttg

SEQ ID NO: 15771 - DNA, 20 bp, Artificial Sequence
  Synthetic construct
cctgccgtccacgtgttttg

SEQ ID NO: 15772 - DNA, 20 bp, Artificial Sequence
  Synthetic construct
cctgccggacacgtgttttg

SEQ ID NO: 15773 - DNA, 20 bp, Artificial Sequence
  Synthetic construct
cctgccgggcacgtgttttg

SEQ ID NO: 15774 - DNA, 20 bp, Artificial Sequence
  Synthetic construct
cctgccggtcacgtgttttg

SEQ ID NO: 15775 - DNA, 20 bp, Artificial Sequence
  Synthetic construct
cctgccggcaacgtgttttg

SEQ ID NO: 15776 - DNA, 20 bp, Artificial Sequence
  Synthetic construct
cctgccggcgacgtgttttg

SEQ ID NO: 15777 - DNA, 20 bp, Artificial Sequence
  Synthetic construct
cctgccggctacgtgttttg

SEQ ID NO: 15778 - DNA, 20 bp, Artificial Sequence
  Synthetic construct
cctgccggccccgtgttttg

SEQ ID NO: 15779 - DNA, 20 bp, Artificial Sequence
  Synthetic construct
cctgccggccgcgtgttttg

SEQ ID NO: 15780 - DNA, 20 bp, Artificial Sequence
  Synthetic construct
cctgccggcctcgtgttttg

SEQ ID NO: 15781 - DNA, 20 bp, Artificial Sequence
  Synthetic construct
cctgccggccaagtgttttg

SEQ ID NO: 15782 - DNA, 20 bp, Artificial Sequence
  Synthetic construct
cctgccggccaggtgttttg

SEQ ID NO: 15783 - DNA, 20 bp, Artificial Sequence
  Synthetic construct
cctgccggccatgtgttttg

SEQ ID NO: 15784 - DNA, 20 bp, Artificial Sequence
  Synthetic construct
cctgccggccacatgttttg

SEQ ID NO: 15785 - DNA, 20 bp, Artificial Sequence
  Synthetic construct
cctgccggccacctgttttg

SEQ ID NO: 15786 - DNA, 20 bp, Artificial Sequence
  Synthetic construct
cctgccggccacttgttttg

SEQ ID NO: 15787 - DNA, 20 bp, Artificial Sequence
  Synthetic construct
cctgccggccacgagttttg

SEQ ID NO: 15788 - DNA, 20 bp, Artificial Sequence
  Synthetic construct
cctgccggccacgcgttttg

SEQ ID NO: 15789 - DNA, 20 bp, Artificial Sequence
  Synthetic construct
cctgccggccacgggttttg

SEQ ID NO: 15790 - DNA, 20 bp, Artificial Sequence
  Synthetic construct
cctgccggccacgtattttg

SEQ ID NO: 15791 - DNA, 20 bp, Artificial Sequence
  Synthetic construct
cctgccggccacgtcttttg

SEQ ID NO: 15792 - DNA, 20 bp, Artificial Sequence
  Synthetic construct
cctgccggccacgttttttg

SEQ ID NO: 15793 - DNA, 20 bp, Artificial Sequence
  Synthetic construct
cctgccggccacgtgatttg

SEQ ID NO: 15794 - DNA, 20 bp, Artificial Sequence
  Synthetic construct
cctgccggccacgtgctttg

SEQ ID NO: 15795 - DNA, 20 bp, Artificial Sequence
  Synthetic construct
cctgccggccacgtggtttg

SEQ ID NO: 15796 - DNA, 20 bp, Artificial Sequence
  Synthetic construct
cctgccggccacgtgtattg

SEQ ID NO: 15797 - DNA, 20 bp, Artificial Sequence
  Synthetic construct
cctgccggccacgtgtcttg

SEQ ID NO: 15798 - DNA, 20 bp, Artificial Sequence
  Synthetic construct
cctgccggccacgtgtgttg

SEQ ID NO: 15799 - DNA, 20 bp, Artificial Sequence
  Synthetic construct
cctgccggccacgtgttatg

SEQ ID NO: 15800 - DNA, 20 bp, Artificial Sequence
  Synthetic construct
cctgccggccacgtgttctg

SEQ ID NO: 15801 - DNA, 20 bp, Artificial Sequence
  Synthetic construct
cctgccggccacgtgttgtg

SEQ ID NO: 15802 - DNA, 20 bp, Artificial Sequence
  Synthetic construct
cctgccggccacgtgtttag

SEQ ID NO: 15803 - DNA, 20 bp, Artificial Sequence
  Synthetic construct
cctgccggccacgtgtttcg

SEQ ID NO: 15804 - DNA, 20 bp, Artificial Sequence
  Synthetic construct
cctgccggccacgtgtttgg

SEQ ID NO: 15805 - DNA, 20 bp, Artificial Sequence
  Synthetic construct
cctgccggccacgtgtttta

SEQ ID NO: 15806 - DNA, 20 bp, Artificial Sequence
  Synthetic construct
cctgccggccacgtgttttc

SEQ ID NO: 15807 - DNA, 20 bp, Artificial Sequence
  Synthetic construct
cctgccggccacgtgttttt

SEQ ID NO: 15808 - DNA, 21 bp, Artificial Sequence
  Synthetic construct
agtcgcgagttgtgaggctgt

SEQ ID NO: 15809 - DNA, 21 bp, Artificial Sequence
  Synthetic construct
ggtcgcgagttgtgaggctgt

SEQ ID NO: 15810 - DNA, 21 bp, Artificial Sequence
  Synthetic construct
tgtcgcgagttgtgaggctgt

SEQ ID NO: 15811 - DNA, 21 bp, Artificial Sequence
  Synthetic construct
catcgcgagttgtgaggctgt

SEQ ID NO: 15812 - DNA, 21 bp, Artificial Sequence
  Synthetic construct
cctcgcgagttgtgaggctgt

SEQ ID NO: 15813 - DNA, 21 bp, Artificial Sequence
  Synthetic construct
cttcgcgagttgtgaggctgt

SEQ ID NO: 15814 - DNA, 21 bp, Artificial Sequence
  Synthetic construct
cgacgcgagttgtgaggctgt

SEQ ID NO: 15815 - DNA, 21 bp, Artificial Sequence
  Synthetic construct
cgccgcgagttgtgaggctgt

SEQ ID NO: 15816 - DNA, 21 bp, Artificial Sequence
  Synthetic construct
cggcgcgagttgtgaggctgt

SEQ ID NO: 15817 - DNA, 21 bp, Artificial Sequence
  Synthetic construct
cgtagcgagttgtgaggctgt

SEQ ID NO: 15818 - DNA, 21 bp, Artificial Sequence
  Synthetic construct
cgtggcgagttgtgaggctgt

SEQ ID NO: 15819 - DNA, 21 bp, Artificial Sequence
  Synthetic construct
cgttgcgagttgtgaggctgt

SEQ ID NO: 15820 - DNA, 21 bp, Artificial Sequence
  Synthetic construct
cgtcacgagttgtgaggctgt

SEQ ID NO: 15821 - DNA, 21 bp, Artificial Sequence
  Synthetic construct
cgtcccgagttgtgaggctgt

SEQ ID NO: 15822 - DNA, 21 bp, Artificial Sequence
  Synthetic construct
cgtctcgagttgtgaggctgt

SEQ ID NO: 15823 - DNA, 21 bp, Artificial Sequence
  Synthetic construct
cgtcgagagttgtgaggctgt

SEQ ID NO: 15824 - DNA, 21 bp, Artificial Sequence
  Synthetic construct
cgtcgggagttgtgaggctgt

SEQ ID NO: 15825 - DNA, 21 bp, Artificial Sequence
  Synthetic construct
cgtcgtgagttgtgaggctgt

SEQ ID NO: 15826 - DNA, 21 bp, Artificial Sequence
  Synthetic construct
cgtcgcaagttgtgaggctgt

SEQ ID NO: 15827 - DNA, 21 bp, Artificial Sequence
  Synthetic construct
cgtcgccagttgtgaggctgt

SEQ ID NO: 15828 - DNA, 21 bp, Artificial Sequence
  Synthetic construct
cgtcgctagttgtgaggctgt

SEQ ID NO: 15829 - DNA, 21 bp, Artificial Sequence
  Synthetic construct
cgtcgcgcgttgtgaggctgt

SEQ ID NO: 15830 - DNA, 21 bp, Artificial Sequence
  Synthetic construct
cgtcgcgggttgtgaggctgt

SEQ ID NO: 15831 - DNA, 21 bp, Artificial Sequence
  Synthetic construct
cgtcgcgtgttgtgaggctgt

SEQ ID NO: 15832 - DNA, 21 bp, Artificial Sequence
  Synthetic construct
cgtcgcgaattgtgaggctgt

SEQ ID NO: 15833 - DNA, 21 bp, Artificial Sequence
  Synthetic construct
cgtcgcgacttgtgaggctgt

SEQ ID NO: 15834 - DNA, 21 bp, Artificial Sequence
  Synthetic construct
cgtcgcgatttgtgaggctgt

SEQ ID NO: 15835 - DNA, 21 bp, Artificial Sequence
  Synthetic construct
cgtcgcgagatgtgaggctgt

SEQ ID NO: 15836 - DNA, 21 bp, Artificial Sequence
  Synthetic construct
cgtcgcgagctgtgaggctgt

SEQ ID NO: 15837 - DNA, 21 bp, Artificial Sequence
  Synthetic construct
cgtcgcgaggtgtgaggctgt

SEQ ID NO: 15838 - DNA, 21 bp, Artificial Sequence
  Synthetic construct
cgtcgcgagtagtgaggctgt

SEQ ID NO: 15839 - DNA, 21 bp, Artificial Sequence
  Synthetic construct
cgtcgcgagtcgtgaggctgt

SEQ ID NO: 15840 - DNA, 21 bp, Artificial Sequence
  Synthetic construct
cgtcgcgagtggtgaggctgt

SEQ ID NO: 15841 - DNA, 21 bp, Artificial Sequence
  Synthetic construct
cgtcgcgagttatgaggctgt

SEQ ID NO: 15842 - DNA, 21 bp, Artificial Sequence
  Synthetic construct
cgtcgcgagttctgaggctgt

SEQ ID NO: 15843 - DNA, 21 bp, Artificial Sequence
  Synthetic construct
cgtcgcgagttttgaggctgt

SEQ ID NO: 15844 - DNA, 21 bp, Artificial Sequence
  Synthetic construct
cgtcgcgagttgagaggctgt

SEQ ID NO: 15845 - DNA, 21 bp, Artificial Sequence
  Synthetic construct
cgtcgcgagttgcgaggctgt

SEQ ID NO: 15846 - DNA, 21 bp, Artificial Sequence
  Synthetic construct
cgtcgcgagttgggaggctgt

SEQ ID NO: 15847 - DNA, 21 bp, Artificial Sequence
  Synthetic construct
cgtcgcgagttgtaaggctgt

SEQ ID NO: 15848 - DNA, 21 bp, Artificial Sequence
  Synthetic construct
cgtcgcgagttgtcaggctgt

SEQ ID NO: 15849 - DNA, 21 bp, Artificial Sequence
  Synthetic construct
cgtcgcgagttgttaggctgt

SEQ ID NO: 15850 - DNA, 21 bp, Artificial Sequence
  Synthetic construct
cgtcgcgagttgtgcggctgt

SEQ ID NO: 15851 - DNA, 21 bp, Artificial Sequence
  Synthetic construct
cgtcgcgagttgtggggctgt

SEQ ID NO: 15852 - DNA, 21 bp, Artificial Sequence
  Synthetic construct
cgtcgcgagttgtgtggctgt

SEQ ID NO: 15853 - DNA, 21 bp, Artificial Sequence
  Synthetic construct
cgtcgcgagttgtgaagctgt

SEQ ID NO: 15854 - DNA, 21 bp, Artificial Sequence
  Synthetic construct
cgtcgcgagttgtgacgctgt

SEQ ID NO: 15855 - DNA, 21 bp, Artificial Sequence
  Synthetic construct
cgtcgcgagttgtgatgctgt

SEQ ID NO: 15856 - DNA, 21 bp, Artificial Sequence
  Synthetic construct
cgtcgcgagttgtgagactgt

SEQ ID NO: 15857 - DNA, 21 bp, Artificial Sequence
  Synthetic construct
cgtcgcgagttgtgagcctgt

SEQ ID NO: 15858 - DNA, 21 bp, Artificial Sequence
  Synthetic construct
cgtcgcgagttgtgagtctgt

SEQ ID NO: 15859 - DNA, 21 bp, Artificial Sequence
  Synthetic construct
cgtcgcgagttgtgaggatgt

SEQ ID NO: 15860 - DNA, 21 bp, Artificial Sequence
  Synthetic construct
cgtcgcgagttgtgagggtgt

SEQ ID NO: 15861 - DNA, 21 bp, Artificial Sequence
  Synthetic construct
cgtcgcgagttgtgaggttgt

SEQ ID NO: 15862 - DNA, 21 bp, Artificial Sequence
  Synthetic construct
cgtcgcgagttgtgaggcagt

SEQ ID NO: 15863 - DNA, 21 bp, Artificial Sequence
  Synthetic construct
cgtcgcgagttgtgaggccgt

SEQ ID NO: 15864 - DNA, 21 bp, Artificial Sequence
  Synthetic construct
cgtcgcgagttgtgaggcggt

SEQ ID NO: 15865 - DNA, 21 bp, Artificial Sequence
  Synthetic construct
cgtcgcgagttgtgaggctat

SEQ ID NO: 15866 - DNA, 21 bp, Artificial Sequence
  Synthetic construct
cgtcgcgagttgtgaggctct

SEQ ID NO: 15867 - DNA, 21 bp, Artificial Sequence
  Synthetic construct
cgtcgcgagttgtgaggcttt

SEQ ID NO: 15868 - DNA, 21 bp, Artificial Sequence
  Synthetic construct
cgtcgcgagttgtgaggctga

SEQ ID NO: 15869 - DNA, 21 bp, Artificial Sequence
  Synthetic construct
cgtcgcgagttgtgaggctgc

SEQ ID NO: 15870 - DNA, 21 bp, Artificial Sequence
  Synthetic construct
cgtcgcgagttgtgaggctgg

SEQ ID NO: 15871 - DNA, 22 bp, Artificial Sequence
  Synthetic construct
ctctaacttgatgttagtaccg

SEQ ID NO: 15872 - DNA, 22 bp, Artificial Sequence
  Synthetic construct
gtctaacttgatgttagtaccg

SEQ ID NO: 15873 - DNA, 22 bp, Artificial Sequence
  Synthetic construct
ttctaacttgatgttagtaccg

SEQ ID NO: 15874 - DNA, 22 bp, Artificial Sequence
  Synthetic construct
aactaacttgatgttagtaccg

SEQ ID NO: 15875 - DNA, 22 bp, Artificial Sequence
  Synthetic construct
acctaacttgatgttagtaccg

SEQ ID NO: 15876 - DNA, 22 bp, Artificial Sequence
  Synthetic construct
agctaacttgatgttagtaccg

SEQ ID NO: 15877 - DNA, 22 bp, Artificial Sequence
  Synthetic construct
atataacttgatgttagtaccg

SEQ ID NO: 15878 - DNA, 22 bp, Artificial Sequence
  Synthetic construct
atgtaacttgatgttagtaccg

SEQ ID NO: 15879 - DNA, 22 bp, Artificial Sequence
  Synthetic construct
atttaacttgatgttagtaccg

SEQ ID NO: 15880 - DNA, 22 bp, Artificial Sequence
  Synthetic construct
atcaaacttgatgttagtaccg

SEQ ID NO: 15881 - DNA, 22 bp, Artificial Sequence
  Synthetic construct
atccaacttgatgttagtaccg

SEQ ID NO: 15882 - DNA, 22 bp, Artificial Sequence
  Synthetic construct
atcgaacttgatgttagtaccg

SEQ ID NO: 15883 - DNA, 22 bp, Artificial Sequence
  Synthetic construct
atctcacttgatgttagtaccg

SEQ ID NO: 15884 - DNA, 22 bp, Artificial Sequence
  Synthetic construct
atctgacttgatgttagtaccg

SEQ ID NO: 15885 - DNA, 22 bp, Artificial Sequence
  Synthetic construct
atcttacttgatgttagtaccg

SEQ ID NO: 15886 - DNA, 22 bp, Artificial Sequence
  Synthetic construct
atctaccttgatgttagtaccg

SEQ ID NO: 15887 - DNA, 22 bp, Artificial Sequence
  Synthetic construct
atctagcttgatgttagtaccg

SEQ ID NO: 15888 - DNA, 22 bp, Artificial Sequence
  Synthetic construct
atctatcttgatgttagtaccg

SEQ ID NO: 15889 - DNA, 22 bp, Artificial Sequence
  Synthetic construct
atctaaattgatgttagtaccg

SEQ ID NO: 15890 - DNA, 22 bp, Artificial Sequence
  Synthetic construct
atctaagttgatgttagtaccg

SEQ ID NO: 15891 - DNA, 22 bp, Artificial Sequence
  Synthetic construct
atctaatttgatgttagtaccg

SEQ ID NO: 15892 - DNA, 22 bp, Artificial Sequence
  Synthetic construct
atctaacatgatgttagtaccg

SEQ ID NO: 15893 - DNA, 22 bp, Artificial Sequence
  Synthetic construct
atctaacctgatgttagtaccg

SEQ ID NO: 15894 - DNA, 22 bp, Artificial Sequence
  Synthetic construct
atctaacgtgatgttagtaccg

SEQ ID NO: 15895 - DNA, 22 bp, Artificial Sequence
  Synthetic construct
atctaactagatgttagtaccg

SEQ ID NO: 15896 - DNA, 22 bp, Artificial Sequence
  Synthetic construct
atctaactcgatgttagtaccg

SEQ ID NO: 15897 - DNA, 22 bp, Artificial Sequence
  Synthetic construct
atctaactggatgttagtaccg

SEQ ID NO: 15898 - DNA, 22 bp, Artificial Sequence
  Synthetic construct
atctaacttaatgttagtaccg

SEQ ID NO: 15899 - DNA, 22 bp, Artificial Sequence
  Synthetic construct
atctaacttcatgttagtaccg

SEQ ID NO: 15900 - DNA, 22 bp, Artificial Sequence
  Synthetic construct
atctaactttatgttagtaccg

SEQ ID NO: 15901 - DNA, 22 bp, Artificial Sequence
  Synthetic construct
atctaacttgctgttagtaccg

SEQ ID NO: 15902 - DNA, 22 bp, Artificial Sequence
  Synthetic construct
atctaacttggtgttagtaccg

SEQ ID NO: 15903 - DNA, 22 bp, Artificial Sequence
  Synthetic construct
atctaacttgttgttagtaccg

SEQ ID NO: 15904 - DNA, 22 bp, Artificial Sequence
  Synthetic construct
atctaacttgaagttagtaccg

SEQ ID NO: 15905 - DNA, 22 bp, Artificial Sequence
  Synthetic construct
atctaacttgacgttagtaccg

SEQ ID NO: 15906 - DNA, 22 bp, Artificial Sequence
  Synthetic construct
atctaacttgaggttagtaccg

SEQ ID NO: 15907 - DNA, 22 bp, Artificial Sequence
  Synthetic construct
atctaacttgatattagtaccg

SEQ ID NO: 15908 - DNA, 22 bp, Artificial Sequence
  Synthetic construct
atctaacttgatcttagtaccg

SEQ ID NO: 15909 - DNA, 22 bp, Artificial Sequence
  Synthetic construct
atctaacttgattttagtaccg

SEQ ID NO: 15910 - DNA, 22 bp, Artificial Sequence
  Synthetic construct
atctaacttgatgatagtaccg

SEQ ID NO: 15911 - DNA, 22 bp, Artificial Sequence
  Synthetic construct
atctaacttgatgctagtaccg

SEQ ID NO: 15912 - DNA, 22 bp, Artificial Sequence
  Synthetic construct
atctaacttgatggtagtaccg

SEQ ID NO: 15913 - DNA, 22 bp, Artificial Sequence
  Synthetic construct
atctaacttgatgtaagtaccg

SEQ ID NO: 15914 - DNA, 22 bp, Artificial Sequence
  Synthetic construct
atctaacttgatgtcagtaccg

SEQ ID NO: 15915 - DNA, 22 bp, Artificial Sequence
  Synthetic construct
atctaacttgatgtgagtaccg

SEQ ID NO: 15916 - DNA, 22 bp, Artificial Sequence
  Synthetic construct
atctaacttgatgttcgtaccg

SEQ ID NO: 15917 - DNA, 22 bp, Artificial Sequence
  Synthetic construct
atctaacttgatgttggtaccg

SEQ ID NO: 15918 - DNA, 22 bp, Artificial Sequence
  Synthetic construct
atctaacttgatgtttgtaccg

SEQ ID NO: 15919 - DNA, 22 bp, Artificial Sequence
  Synthetic construct
atctaacttgatgttaataccg

SEQ ID NO: 15920 - DNA, 22 bp, Artificial Sequence
  Synthetic construct
atctaacttgatgttactaccg

SEQ ID NO: 15921 - DNA, 22 bp, Artificial Sequence
  Synthetic construct
atctaacttgatgttattaccg

SEQ ID NO: 15922 - DNA, 22 bp, Artificial Sequence
  Synthetic construct
atctaacttgatgttagaaccg

SEQ ID NO: 15923 - DNA, 22 bp, Artificial Sequence
  Synthetic construct
atctaacttgatgttagcaccg

SEQ ID NO: 15924 - DNA, 22 bp, Artificial Sequence
  Synthetic construct
atctaacttgatgttaggaccg

SEQ ID NO: 15925 - DNA, 22 bp, Artificial Sequence
  Synthetic construct
atctaacttgatgttagtcccg

SEQ ID NO: 15926 - DNA, 22 bp, Artificial Sequence
  Synthetic construct
atctaacttgatgttagtgccg

SEQ ID NO: 15927 - DNA, 22 bp, Artificial Sequence
  Synthetic construct
atctaacttgatgttagttccg

SEQ ID NO: 15928 - DNA, 22 bp, Artificial Sequence
  Synthetic construct
atctaacttgatgttagtaacg

SEQ ID NO: 15929 - DNA, 22 bp, Artificial Sequence
  Synthetic construct
atctaacttgatgttagtagcg

SEQ ID NO: 15930 - DNA, 22 bp, Artificial Sequence
  Synthetic construct
atctaacttgatgttagtatcg

SEQ ID NO: 15931 - DNA, 22 bp, Artificial Sequence
  Synthetic construct
atctaacttgatgttagtacag

SEQ ID NO: 15932 - DNA, 22 bp, Artificial Sequence
  Synthetic construct
atctaacttgatgttagtacgg

SEQ ID NO: 15933 - DNA, 22 bp, Artificial Sequence
  Synthetic construct
atctaacttgatgttagtactg

SEQ ID NO: 15934 - DNA, 22 bp, Artificial Sequence
  Synthetic construct
atctaacttgatgttagtacca

SEQ ID NO: 15935 - DNA, 22 bp, Artificial Sequence
  Synthetic construct
atctaacttgatgttagtaccc

SEQ ID NO: 15936 - DNA, 22 bp, Artificial Sequence
  Synthetic construct
atctaacttgatgttagtacct

SEQ ID NO: 15937 - DNA, 22 bp, Artificial Sequence
  Synthetic construct
ccgtacggctctcataggaaga

SEQ ID NO: 15938 - DNA, 22 bp, Artificial Sequence
  Synthetic construct
gcgtacggctctcataggaaga

SEQ ID NO: 15939 - DNA, 22 bp, Artificial Sequence
  Synthetic construct
tcgtacggctctcataggaaga

SEQ ID NO: 15940 - DNA, 22 bp, Artificial Sequence
  Synthetic construct
aagtacggctctcataggaaga

SEQ ID NO: 15941 - DNA, 22 bp, Artificial Sequence
  Synthetic construct
aggtacggctctcataggaaga

SEQ ID NO: 15942 - DNA, 22 bp, Artificial Sequence
  Synthetic construct
atgtacggctctcataggaaga

SEQ ID NO: 15943 - DNA, 22 bp, Artificial Sequence
  Synthetic construct
acatacggctctcataggaaga

SEQ ID NO: 15944 - DNA, 22 bp, Artificial Sequence
  Synthetic construct
acctacggctctcataggaaga

SEQ ID NO: 15945 - DNA, 22 bp, Artificial Sequence
  Synthetic construct
acttacggctctcataggaaga

SEQ ID NO: 15946 - DNA, 22 bp, Artificial Sequence
  Synthetic construct
acgaacggctctcataggaaga

SEQ ID NO: 15947 - DNA, 22 bp, Artificial Sequence
  Synthetic construct
acgcacggctctcataggaaga

SEQ ID NO: 15948 - DNA, 22 bp, Artificial Sequence
  Synthetic construct
acggacggctctcataggaaga

SEQ ID NO: 15949 - DNA, 22 bp, Artificial Sequence
  Synthetic construct
acgtccggctctcataggaaga

SEQ ID NO: 15950 - DNA, 22 bp, Artificial Sequence
  Synthetic construct
acgtgcggctctcataggaaga

SEQ ID NO: 15951 - DNA, 22 bp, Artificial Sequence
  Synthetic construct
acgttcggctctcataggaaga

SEQ ID NO: 15952 - DNA, 22 bp, Artificial Sequence
  Synthetic construct
acgtaaggctctcataggaaga

SEQ ID NO: 15953 - DNA, 22 bp, Artificial Sequence
  Synthetic construct
acgtagggctctcataggaaga

SEQ ID NO: 15954 - DNA, 22 bp, Artificial Sequence
  Synthetic construct
acgtatggctctcataggaaga

SEQ ID NO: 15955 - DNA, 22 bp, Artificial Sequence
  Synthetic construct
acgtacagctctcataggaaga

SEQ ID NO: 15956 - DNA, 22 bp, Artificial Sequence
  Synthetic construct
acgtaccgctctcataggaaga

SEQ ID NO: 15957 - DNA, 22 bp, Artificial Sequence
  Synthetic construct
acgtactgctctcataggaaga

SEQ ID NO: 15958 - DNA, 22 bp, Artificial Sequence
  Synthetic construct
acgtacgactctcataggaaga

SEQ ID NO: 15959 - DNA, 22 bp, Artificial Sequence
  Synthetic construct
acgtacgcctctcataggaaga

SEQ ID NO: 15960 - DNA, 22 bp, Artificial Sequence
  Synthetic construct
acgtacgtctctcataggaaga

SEQ ID NO: 15961 - DNA, 22 bp, Artificial Sequence
  Synthetic construct
acgtacggatctcataggaaga

SEQ ID NO: 15962 - DNA, 22 bp, Artificial Sequence
  Synthetic construct
acgtacgggtctcataggaaga

SEQ ID NO: 15963 - DNA, 22 bp, Artificial Sequence
  Synthetic construct
acgtacggttctcataggaaga

SEQ ID NO: 15964 - DNA, 22 bp, Artificial Sequence
  Synthetic construct
acgtacggcactcataggaaga

SEQ ID NO: 15965 - DNA, 22 bp, Artificial Sequence
  Synthetic construct
acgtacggccctcataggaaga

SEQ ID NO: 15966 - DNA, 22 bp, Artificial Sequence
  Synthetic construct
acgtacggcgctcataggaaga

SEQ ID NO: 15967 - DNA, 22 bp, Artificial Sequence
  Synthetic construct
acgtacggctatcataggaaga

SEQ ID NO: 15968 - DNA, 22 bp, Artificial Sequence
  Synthetic construct
acgtacggctgtcataggaaga

SEQ ID NO: 15969 - DNA, 22 bp, Artificial Sequence
  Synthetic construct
acgtacggctttcataggaaga

SEQ ID NO: 15970 - DNA, 22 bp, Artificial Sequence
  Synthetic construct
acgtacggctcacataggaaga

SEQ ID NO: 15971 - DNA, 22 bp, Artificial Sequence
  Synthetic construct
acgtacggctcccataggaaga

SEQ ID NO: 15972 - DNA, 22 bp, Artificial Sequence
  Synthetic construct
acgtacggctcgcataggaaga

SEQ ID NO: 15973 - DNA, 22 bp, Artificial Sequence
  Synthetic construct
acgtacggctctaataggaaga

SEQ ID NO: 15974 - DNA, 22 bp, Artificial Sequence
  Synthetic construct
acgtacggctctgataggaaga

SEQ ID NO: 15975 - DNA, 22 bp, Artificial Sequence
  Synthetic construct
acgtacggctcttataggaaga

SEQ ID NO: 15976 - DNA, 22 bp, Artificial Sequence
  Synthetic construct
acgtacggctctcctaggaaga

SEQ ID NO: 15977 - DNA, 22 bp, Artificial Sequence
  Synthetic construct
acgtacggctctcgtaggaaga

SEQ ID NO: 15978 - DNA, 22 bp, Artificial Sequence
  Synthetic construct
acgtacggctctcttaggaaga

SEQ ID NO: 15979 - DNA, 22 bp, Artificial Sequence
  Synthetic construct
acgtacggctctcaaaggaaga

SEQ ID NO: 15980 - DNA, 22 bp, Artificial Sequence
  Synthetic construct
acgtacggctctcacaggaaga

SEQ ID NO: 15981 - DNA, 22 bp, Artificial Sequence
  Synthetic construct
acgtacggctctcagaggaaga

SEQ ID NO: 15982 - DNA, 22 bp, Artificial Sequence
  Synthetic construct
acgtacggctctcatcggaaga

SEQ ID NO: 15983 - DNA, 22 bp, Artificial Sequence
  Synthetic construct
acgtacggctctcatgggaaga

SEQ ID NO: 15984 - DNA, 22 bp, Artificial Sequence
  Synthetic construct
acgtacggctctcattggaaga

SEQ ID NO: 15985 - DNA, 22 bp, Artificial Sequence
  Synthetic construct
acgtacggctctcataagaaga

SEQ ID NO: 15986 - DNA, 22 bp, Artificial Sequence
  Synthetic construct
acgtacggctctcatacgaaga

SEQ ID NO: 15987 - DNA, 22 bp, Artificial Sequence
  Synthetic construct
acgtacggctctcatatgaaga

SEQ ID NO: 15988 - DNA, 22 bp, Artificial Sequence
  Synthetic construct
acgtacggctctcatagaaaga

SEQ ID NO: 15989 - DNA, 22 bp, Artificial Sequence
  Synthetic construct
acgtacggctctcatagcaaga

SEQ ID NO: 15990 - DNA, 22 bp, Artificial Sequence
  Synthetic construct
acgtacggctctcatagtaaga

SEQ ID NO: 15991 - DNA, 22 bp, Artificial Sequence
  Synthetic construct
acgtacggctctcataggcaga

SEQ ID NO: 15992 - DNA, 22 bp, Artificial Sequence
  Synthetic construct
acgtacggctctcatagggaga

SEQ ID NO: 15993 - DNA, 22 bp, Artificial Sequence
  Synthetic construct
acgtacggctctcataggtaga

SEQ ID NO: 15994 - DNA, 22 bp, Artificial Sequence
  Synthetic construct
acgtacggctctcataggacga

SEQ ID NO: 15995 - DNA, 22 bp, Artificial Sequence
  Synthetic construct
acgtacggctctcataggagga

SEQ ID NO: 15996 - DNA, 22 bp, Artificial Sequence
  Synthetic construct
acgtacggctctcataggatga

SEQ ID NO: 15997 - DNA, 22 bp, Artificial Sequence
  Synthetic construct
acgtacggctctcataggaaaa

SEQ ID NO: 15998 - DNA, 22 bp, Artificial Sequence
  Synthetic construct
acgtacggctctcataggaaca

SEQ ID NO: 15999 - DNA, 22 bp, Artificial Sequence
  Synthetic construct
acgtacggctctcataggaata

SEQ ID NO: 16000 - DNA, 22 bp, Artificial Sequence
  Synthetic construct
acgtacggctctcataggaagc

SEQ ID NO: 16001 - DNA, 22 bp, Artificial Sequence
  Synthetic construct
acgtacggctctcataggaagg

SEQ ID NO: 16002 - DNA, 22 bp, Artificial Sequence
  Synthetic construct
acgtacggctctcataggaagt

SEQ ID NO: 16003 - DNA, 22 bp, Artificial Sequence
  Synthetic construct
agctgtagcaggagcgtgcgtc

SEQ ID NO: 16004 - DNA, 22 bp, Artificial Sequence
  Synthetic construct
cgctgtagcaggagcgtgcgtc

SEQ ID NO: 16005 - DNA, 22 bp, Artificial Sequence
  Synthetic construct
tgctgtagcaggagcgtgcgtc

SEQ ID NO: 16006 - DNA, 22 bp, Artificial Sequence
  Synthetic construct
gactgtagcaggagcgtgcgtc

SEQ ID NO: 16007 - DNA, 22 bp, Artificial Sequence
  Synthetic construct
gcctgtagcaggagcgtgcgtc

SEQ ID NO: 16008 - DNA, 22 bp, Artificial Sequence
  Synthetic construct
gtctgtagcaggagcgtgcgtc

SEQ ID NO: 16009 - DNA, 22 bp, Artificial Sequence
  Synthetic construct
ggatgtagcaggagcgtgcgtc

SEQ ID NO: 16010 - DNA, 22 bp, Artificial Sequence
  Synthetic construct
gggtgtagcaggagcgtgcgtc

SEQ ID NO: 16011 - DNA, 22 bp, Artificial Sequence
  Synthetic construct
ggttgtagcaggagcgtgcgtc

SEQ ID NO: 16012 - DNA, 22 bp, Artificial Sequence
  Synthetic construct
ggcagtagcaggagcgtgcgtc

SEQ ID NO: 16013 - DNA, 22 bp, Artificial Sequence
  Synthetic construct
ggccgtagcaggagcgtgcgtc

SEQ ID NO: 16014 - DNA, 22 bp, Artificial Sequence
  Synthetic construct
ggcggtagcaggagcgtgcgtc

SEQ ID NO: 16015 - DNA, 22 bp, Artificial Sequence
  Synthetic construct
ggctatagcaggagcgtgcgtc

SEQ ID NO: 16016 - DNA, 22 bp, Artificial Sequence
  Synthetic construct
ggctctagcaggagcgtgcgtc

SEQ ID NO: 16017 - DNA, 22 bp, Artificial Sequence
  Synthetic construct
ggctttagcaggagcgtgcgtc

SEQ ID NO: 16018 - DNA, 22 bp, Artificial Sequence
  Synthetic construct
ggctgaagcaggagcgtgcgtc

SEQ ID NO: 16019 - DNA, 22 bp, Artificial Sequence
  Synthetic construct
ggctgcagcaggagcgtgcgtc

SEQ ID NO: 16020 - DNA, 22 bp, Artificial Sequence
  Synthetic construct
ggctggagcaggagcgtgcgtc

SEQ ID NO: 16021 - DNA, 22 bp, Artificial Sequence
  Synthetic construct
ggctgtcgcaggagcgtgcgtc

SEQ ID NO: 16022 - DNA, 22 bp, Artificial Sequence
  Synthetic construct
ggctgtggcaggagcgtgcgtc

SEQ ID NO: 16023 - DNA, 22 bp, Artificial Sequence
  Synthetic construct
ggctgttgcaggagcgtgcgtc

SEQ ID NO: 16024 - DNA, 22 bp, Artificial Sequence
  Synthetic construct
ggctgtaacaggagcgtgcgtc

SEQ ID NO: 16025 - DNA, 22 bp, Artificial Sequence
  Synthetic construct
ggctgtaccaggagcgtgcgtc

SEQ ID NO: 16026 - DNA, 22 bp, Artificial Sequence
  Synthetic construct
ggctgtatcaggagcgtgcgtc

SEQ ID NO: 16027 - DNA, 22 bp, Artificial Sequence
  Synthetic construct
ggctgtagaaggagcgtgcgtc

SEQ ID NO: 16028 - DNA, 22 bp, Artificial Sequence
  Synthetic construct
ggctgtaggaggagcgtgcgtc

SEQ ID NO: 16029 - DNA, 22 bp, Artificial Sequence
  Synthetic construct
ggctgtagtaggagcgtgcgtc

SEQ ID NO: 16030 - DNA, 22 bp, Artificial Sequence
  Synthetic construct
ggctgtagccggagcgtgcgtc

SEQ ID NO: 16031 - DNA, 22 bp, Artificial Sequence
  Synthetic construct
ggctgtagcgggagcgtgcgtc

SEQ ID NO: 16032 - DNA, 22 bp, Artificial Sequence
  Synthetic construct
ggctgtagctggagcgtgcgtc

SEQ ID NO: 16033 - DNA, 22 bp, Artificial Sequence
  Synthetic construct
ggctgtagcaagagcgtgcgtc

SEQ ID NO: 16034 - DNA, 22 bp, Artificial Sequence
  Synthetic construct
ggctgtagcacgagcgtgcgtc

SEQ ID NO: 16035 - DNA, 22 bp, Artificial Sequence
  Synthetic construct
ggctgtagcatgagcgtgcgtc

SEQ ID NO: 16036 - DNA, 22 bp, Artificial Sequence
  Synthetic construct
ggctgtagcagaagcgtgcgtc

SEQ ID NO: 16037 - DNA, 22 bp, Artificial Sequence
  Synthetic construct
ggctgtagcagcagcgtgcgtc

SEQ ID NO: 16038 - DNA, 22 bp, Artificial Sequence
  Synthetic construct
ggctgtagcagtagcgtgcgtc

SEQ ID NO: 16039 - DNA, 22 bp, Artificial Sequence
  Synthetic construct
ggctgtagcaggcgcgtgcgtc

SEQ ID NO: 16040 - DNA, 22 bp, Artificial Sequence
  Synthetic construct
ggctgtagcaggggcgtgcgtc

SEQ ID NO: 16041 - DNA, 22 bp, Artificial Sequence
  Synthetic construct
ggctgtagcaggtgcgtgcgtc

SEQ ID NO: 16042 - DNA, 22 bp, Artificial Sequence
  Synthetic construct
ggctgtagcaggaacgtgcgtc

SEQ ID NO: 16043 - DNA, 22 bp, Artificial Sequence
  Synthetic construct
ggctgtagcaggaccgtgcgtc

SEQ ID NO: 16044 - DNA, 22 bp, Artificial Sequence
  Synthetic construct
ggctgtagcaggatcgtgcgtc

SEQ ID NO: 16045 - DNA, 22 bp, Artificial Sequence
  Synthetic construct
ggctgtagcaggagagtgcgtc

SEQ ID NO: 16046 - DNA, 22 bp, Artificial Sequence
  Synthetic construct
ggctgtagcaggagggtgcgtc

SEQ ID NO: 16047 - DNA, 22 bp, Artificial Sequence
  Synthetic construct
ggctgtagcaggagtgtgcgtc

SEQ ID NO: 16048 - DNA, 22 bp, Artificial Sequence
  Synthetic construct
ggctgtagcaggagcatgcgtc

SEQ ID NO: 16049 - DNA, 22 bp, Artificial Sequence
  Synthetic construct
ggctgtagcaggagcctgcgtc

SEQ ID NO: 16050 - DNA, 22 bp, Artificial Sequence
  Synthetic construct
ggctgtagcaggagcttgcgtc

SEQ ID NO: 16051 - DNA, 22 bp, Artificial Sequence
  Synthetic construct
ggctgtagcaggagcgagcgtc

SEQ ID NO: 16052 - DNA, 22 bp, Artificial Sequence
  Synthetic construct
ggctgtagcaggagcgcgcgtc

SEQ ID NO: 16053 - DNA, 22 bp, Artificial Sequence
  Synthetic construct
ggctgtagcaggagcgggcgtc

SEQ ID NO: 16054 - DNA, 22 bp, Artificial Sequence
  Synthetic construct
ggctgtagcaggagcgtacgtc

SEQ ID NO: 16055 - DNA, 22 bp, Artificial Sequence
  Synthetic construct
ggctgtagcaggagcgtccgtc

SEQ ID NO: 16056 - DNA, 22 bp, Artificial Sequence
  Synthetic construct
ggctgtagcaggagcgttcgtc

SEQ ID NO: 16057 - DNA, 22 bp, Artificial Sequence
  Synthetic construct
ggctgtagcaggagcgtgagtc

SEQ ID NO: 16058 - DNA, 22 bp, Artificial Sequence
  Synthetic construct
ggctgtagcaggagcgtgggtc

SEQ ID NO: 16059 - DNA, 22 bp, Artificial Sequence
  Synthetic construct
ggctgtagcaggagcgtgtgtc

SEQ ID NO: 16060 - DNA, 22 bp, Artificial Sequence
  Synthetic construct
ggctgtagcaggagcgtgcatc

SEQ ID NO: 16061 - DNA, 22 bp, Artificial Sequence
  Synthetic construct
ggctgtagcaggagcgtgcctc

SEQ ID NO: 16062 - DNA, 22 bp, Artificial Sequence
  Synthetic construct
ggctgtagcaggagcgtgcttc

SEQ ID NO: 16063 - DNA, 22 bp, Artificial Sequence
  Synthetic construct
ggctgtagcaggagcgtgcgac

SEQ ID NO: 16064 - DNA, 22 bp, Artificial Sequence
  Synthetic construct
ggctgtagcaggagcgtgcgcc

SEQ ID NO: 16065 - DNA, 22 bp, Artificial Sequence
  Synthetic construct
ggctgtagcaggagcgtgcggc

SEQ ID NO: 16066 - DNA, 22 bp, Artificial Sequence
  Synthetic construct
ggctgtagcaggagcgtgcgta

SEQ ID NO: 16067 - DNA, 22 bp, Artificial Sequence
  Synthetic construct
ggctgtagcaggagcgtgcgtg

SEQ ID NO: 16068 - DNA, 22 bp, Artificial Sequence
  Synthetic construct
ggctgtagcaggagcgtgcgtt

SEQ ID NO: 16069 - DNA, 21 bp, Artificial Sequence
  Synthetic construct
atcgcgaaagagcccggacac

SEQ ID NO: 16070 - DNA, 21 bp, Artificial Sequence
  Synthetic construct
gtcgcgaaagagcccggacac

SEQ ID NO: 16071 - DNA, 21 bp, Artificial Sequence
  Synthetic construct
ttcgcgaaagagcccggacac

SEQ ID NO: 16072 - DNA, 21 bp, Artificial Sequence
  Synthetic construct
cacgcgaaagagcccggacac

SEQ ID NO: 16073 - DNA, 21 bp, Artificial Sequence
  Synthetic construct
cccgcgaaagagcccggacac

SEQ ID NO: 16074 - DNA, 21 bp, Artificial Sequence
  Synthetic construct
cgcgcgaaagagcccggacac

SEQ ID NO: 16075 - DNA, 21 bp, Artificial Sequence
  Synthetic construct
ctagcgaaagagcccggacac

SEQ ID NO: 16076 - DNA, 21 bp, Artificial Sequence
  Synthetic construct
ctggcgaaagagcccggacac

SEQ ID NO: 16077 - DNA, 21 bp, Artificial Sequence
  Synthetic construct
cttgcgaaagagcccggacac

SEQ ID NO: 16078 - DNA, 21 bp, Artificial Sequence
  Synthetic construct
ctcacgaaagagcccggacac

SEQ ID NO: 16079 - DNA, 21 bp, Artificial Sequence
  Synthetic construct
ctcccgaaagagcccggacac

SEQ ID NO: 16080 - DNA, 21 bp, Artificial Sequence
  Synthetic construct
ctctcgaaagagcccggacac

SEQ ID NO: 16081 - DNA, 21 bp, Artificial Sequence
  Synthetic construct
ctcgagaaagagcccggacac

SEQ ID NO: 16082 - DNA, 21 bp, Artificial Sequence
  Synthetic construct
ctcgggaaagagcccggacac

SEQ ID NO: 16083 - DNA, 21 bp, Artificial Sequence
  Synthetic construct
ctcgtgaaagagcccggacac

SEQ ID NO: 16084 - DNA, 21 bp, Artificial Sequence
  Synthetic construct
ctcgcaaaagagcccggacac

SEQ ID NO: 16085 - DNA, 21 bp, Artificial Sequence
  Synthetic construct
ctcgccaaagagcccggacac

SEQ ID NO: 16086 - DNA, 21 bp, Artificial Sequence
  Synthetic construct
ctcgctaaagagcccggacac

SEQ ID NO: 16087 - DNA, 21 bp, Artificial Sequence
  Synthetic construct
ctcgcgcaagagcccggacac

SEQ ID NO: 16088 - DNA, 21 bp, Artificial Sequence
  Synthetic construct
ctcgcggaagagcccggacac

SEQ ID NO: 16089 - DNA, 21 bp, Artificial Sequence
  Synthetic construct
ctcgcgtaagagcccggacac

SEQ ID NO: 16090 - DNA, 21 bp, Artificial Sequence
  Synthetic construct
ctcgcgacagagcccggacac

SEQ ID NO: 16091 - DNA, 21 bp, Artificial Sequence
  Synthetic construct
ctcgcgagagagcccggacac

SEQ ID NO: 16092 - DNA, 21 bp, Artificial Sequence
  Synthetic construct
ctcgcgatagagcccggacac

SEQ ID NO: 16093 - DNA, 21 bp, Artificial Sequence
  Synthetic construct
ctcgcgaacgagcccggacac

SEQ ID NO: 16094 - DNA, 21 bp, Artificial Sequence
  Synthetic construct
ctcgcgaaggagcccggacac

SEQ ID NO: 16095 - DNA, 21 bp, Artificial Sequence
  Synthetic construct
ctcgcgaatgagcccggacac

SEQ ID NO: 16096 - DNA, 21 bp, Artificial Sequence
  Synthetic construct
ctcgcgaaaaagcccggacac

SEQ ID NO: 16097 - DNA, 21 bp, Artificial Sequence
  Synthetic construct
ctcgcgaaacagcccggacac

SEQ ID NO: 16098 - DNA, 21 bp, Artificial Sequence
  Synthetic construct
ctcgcgaaatagcccggacac

SEQ ID NO: 16099 - DNA, 21 bp, Artificial Sequence
  Synthetic construct
ctcgcgaaagcgcccggacac

SEQ ID NO: 16100 - DNA, 21 bp, Artificial Sequence
  Synthetic construct
ctcgcgaaagggcccggacac

SEQ ID NO: 16101 - DNA, 21 bp, Artificial Sequence
  Synthetic construct
ctcgcgaaagtgcccggacac

SEQ ID NO: 16102 - DNA, 21 bp, Artificial Sequence
  Synthetic construct
ctcgcgaaagaacccggacac

SEQ ID NO: 16103 - DNA, 21 bp, Artificial Sequence
  Synthetic construct
ctcgcgaaagaccccggacac

SEQ ID NO: 16104 - DNA, 21 bp, Artificial Sequence
  Synthetic construct
ctcgcgaaagatcccggacac

SEQ ID NO: 16105 - DNA, 21 bp, Artificial Sequence
  Synthetic construct
ctcgcgaaagagaccggacac

SEQ ID NO: 16106 - DNA, 21 bp, Artificial Sequence
  Synthetic construct
ctcgcgaaagaggccggacac

SEQ ID NO: 16107 - DNA, 21 bp, Artificial Sequence
  Synthetic construct
ctcgcgaaagagtccggacac

SEQ ID NO: 16108 - DNA, 21 bp, Artificial Sequence
  Synthetic construct
ctcgcgaaagagcacggacac

SEQ ID NO: 16109 - DNA, 21 bp, Artificial Sequence
  Synthetic construct
ctcgcgaaagagcgcggacac

SEQ ID NO: 16110 - DNA, 21 bp, Artificial Sequence
  Synthetic construct
ctcgcgaaagagctcggacac

SEQ ID NO: 16111 - DNA, 21 bp, Artificial Sequence
  Synthetic construct
ctcgcgaaagagccaggacac

SEQ ID NO: 16112 - DNA, 21 bp, Artificial Sequence
  Synthetic construct
ctcgcgaaagagccgggacac

SEQ ID NO: 16113 - DNA, 21 bp, Artificial Sequence
  Synthetic construct
ctcgcgaaagagcctggacac

SEQ ID NO: 16114 - DNA, 21 bp, Artificial Sequence
  Synthetic construct
ctcgcgaaagagcccagacac

SEQ ID NO: 16115 - DNA, 21 bp, Artificial Sequence
  Synthetic construct
ctcgcgaaagagccccgacac

SEQ ID NO: 16116 - DNA, 21 bp, Artificial Sequence
  Synthetic construct
ctcgcgaaagagccctgacac

SEQ ID NO: 16117 - DNA, 21 bp, Artificial Sequence
  Synthetic construct
ctcgcgaaagagcccgaacac

SEQ ID NO: 16118 - DNA, 21 bp, Artificial Sequence
  Synthetic construct
ctcgcgaaagagcccgcacac

SEQ ID NO: 16119 - DNA, 21 bp, Artificial Sequence
  Synthetic construct
ctcgcgaaagagcccgtacac

SEQ ID NO: 16120 - DNA, 21 bp, Artificial Sequence
  Synthetic construct
ctcgcgaaagagcccggccac

SEQ ID NO: 16121 - DNA, 21 bp, Artificial Sequence
  Synthetic construct
ctcgcgaaagagcccgggcac

SEQ ID NO: 16122 - DNA, 21 bp, Artificial Sequence
  Synthetic construct
ctcgcgaaagagcccggtcac

SEQ ID NO: 16123 - DNA, 21 bp, Artificial Sequence
  Synthetic construct
ctcgcgaaagagcccggaaac

SEQ ID NO: 16124 - DNA, 21 bp, Artificial Sequence
  Synthetic construct
ctcgcgaaagagcccggagac

SEQ ID NO: 16125 - DNA, 21 bp, Artificial Sequence
  Synthetic construct
ctcgcgaaagagcccggatac

SEQ ID NO: 16126 - DNA, 21 bp, Artificial Sequence
  Synthetic construct
ctcgcgaaagagcccggaccc

SEQ ID NO: 16127 - DNA, 21 bp, Artificial Sequence
  Synthetic construct
ctcgcgaaagagcccggacgc

SEQ ID NO: 16128 - DNA, 21 bp, Artificial Sequence
  Synthetic construct
ctcgcgaaagagcccggactc

SEQ ID NO: 16129 - DNA, 21 bp, Artificial Sequence
  Synthetic construct
ctcgcgaaagagcccggacaa

SEQ ID NO: 16130 - DNA, 21 bp, Artificial Sequence
  Synthetic construct
ctcgcgaaagagcccggacag

SEQ ID NO: 16131 - DNA, 21 bp, Artificial Sequence
  Synthetic construct
ctcgcgaaagagcccggacat

SEQ ID NO: 16132 - DNA, 23 bp, Artificial Sequence
  Synthetic construct
acaccgttggagaacgtgcattg

SEQ ID NO: 16133 - DNA, 23 bp, Artificial Sequence
  Synthetic construct
ccaccgttggagaacgtgcattg

SEQ ID NO: 16134 - DNA, 23 bp, Artificial Sequence
  Synthetic construct
tcaccgttggagaacgtgcattg

SEQ ID NO: 16135 - DNA, 23 bp, Artificial Sequence
  Synthetic construct
gaaccgttggagaacgtgcattg

SEQ ID NO: 16136 - DNA, 23 bp, Artificial Sequence
  Synthetic construct
ggaccgttggagaacgtgcattg

SEQ ID NO: 16137 - DNA, 23 bp, Artificial Sequence
  Synthetic construct
gtaccgttggagaacgtgcattg

SEQ ID NO: 16138 - DNA, 23 bp, Artificial Sequence
  Synthetic construct
gccccgttggagaacgtgcattg

SEQ ID NO: 16139 - DNA, 23 bp, Artificial Sequence
  Synthetic construct
gcgccgttggagaacgtgcattg

SEQ ID NO: 16140 - DNA, 23 bp, Artificial Sequence
  Synthetic construct
gctccgttggagaacgtgcattg

SEQ ID NO: 16141 - DNA, 23 bp, Artificial Sequence
  Synthetic construct
gcaacgttggagaacgtgcattg

SEQ ID NO: 16142 - DNA, 23 bp, Artificial Sequence
  Synthetic construct
gcagcgttggagaacgtgcattg

SEQ ID NO: 16143 - DNA, 23 bp, Artificial Sequence
  Synthetic construct
gcatcgttggagaacgtgcattg

SEQ ID NO: 16144 - DNA, 23 bp, Artificial Sequence
  Synthetic construct
gcacagttggagaacgtgcattg

SEQ ID NO: 16145 - DNA, 23 bp, Artificial Sequence
  Synthetic construct
gcacggttggagaacgtgcattg

SEQ ID NO: 16146 - DNA, 23 bp, Artificial Sequence
  Synthetic construct
gcactgttggagaacgtgcattg

SEQ ID NO: 16147 - DNA, 23 bp, Artificial Sequence
  Synthetic construct
gcaccattggagaacgtgcattg

SEQ ID NO: 16148 - DNA, 23 bp, Artificial Sequence
  Synthetic construct
gcacccttggagaacgtgcattg

SEQ ID NO: 16149 - DNA, 23 bp, Artificial Sequence
  Synthetic construct
gcacctttggagaacgtgcattg

SEQ ID NO: 16150 - DNA, 23 bp, Artificial Sequence
  Synthetic construct
gcaccgatggagaacgtgcattg

SEQ ID NO: 16151 - DNA, 23 bp, Artificial Sequence
  Synthetic construct
gcaccgctggagaacgtgcattg

SEQ ID NO: 16152 - DNA, 23 bp, Artificial Sequence
  Synthetic construct
gcaccggtggagaacgtgcattg

SEQ ID NO: 16153 - DNA, 23 bp, Artificial Sequence
  Synthetic construct
gcaccgtaggagaacgtgcattg

SEQ ID NO: 16154 - DNA, 23 bp, Artificial Sequence
  Synthetic construct
gcaccgtcggagaacgtgcattg

SEQ ID NO: 16155 - DNA, 23 bp, Artificial Sequence
  Synthetic construct
gcaccgtgggagaacgtgcattg

SEQ ID NO: 16156 - DNA, 23 bp, Artificial Sequence
  Synthetic construct
gcaccgttagagaacgtgcattg

SEQ ID NO: 16157 - DNA, 23 bp, Artificial Sequence
  Synthetic construct
gcaccgttcgagaacgtgcattg

SEQ ID NO: 16158 - DNA, 23 bp, Artificial Sequence
  Synthetic construct
gcaccgtttgagaacgtgcattg

SEQ ID NO: 16159 - DNA, 23 bp, Artificial Sequence
  Synthetic construct
gcaccgttgaagaacgtgcattg

SEQ ID NO: 16160 - DNA, 23 bp, Artificial Sequence
  Synthetic construct
gcaccgttgcagaacgtgcattg

SEQ ID NO: 16161 - DNA, 23 bp, Artificial Sequence
  Synthetic construct
gcaccgttgtagaacgtgcattg

SEQ ID NO: 16162 - DNA, 23 bp, Artificial Sequence
  Synthetic construct
gcaccgttggcgaacgtgcattg

SEQ ID NO: 16163 - DNA, 23 bp, Artificial Sequence
  Synthetic construct
gcaccgttggggaacgtgcattg

SEQ ID NO: 16164 - DNA, 23 bp, Artificial Sequence
  Synthetic construct
gcaccgttggtgaacgtgcattg

SEQ ID NO: 16165 - DNA, 23 bp, Artificial Sequence
  Synthetic construct
gcaccgttggaaaacgtgcattg

SEQ ID NO: 16166 - DNA, 23 bp, Artificial Sequence
  Synthetic construct
gcaccgttggacaacgtgcattg

SEQ ID NO: 16167 - DNA, 23 bp, Artificial Sequence
  Synthetic construct
gcaccgttggataacgtgcattg

SEQ ID NO: 16168 - DNA, 23 bp, Artificial Sequence
  Synthetic construct
gcaccgttggagcacgtgcattg

SEQ ID NO: 16169 - DNA, 23 bp, Artificial Sequence
  Synthetic construct
gcaccgttggaggacgtgcattg

SEQ ID NO: 16170 - DNA, 23 bp, Artificial Sequence
  Synthetic construct
gcaccgttggagtacgtgcattg

SEQ ID NO: 16171 - DNA, 23 bp, Artificial Sequence
  Synthetic construct
gcaccgttggagaccgtgcattg

SEQ ID NO: 16172 - DNA, 23 bp, Artificial Sequence
  Synthetic construct
gcaccgttggagagcgtgcattg

SEQ ID NO: 16173 - DNA, 23 bp, Artificial Sequence
  Synthetic construct
gcaccgttggagatcgtgcattg

SEQ ID NO: 16174 - DNA, 23 bp, Artificial Sequence
  Synthetic construct
gcaccgttggagaaagtgcattg

SEQ ID NO: 16175 - DNA, 23 bp, Artificial Sequence
  Synthetic construct
gcaccgttggagaaggtgcattg

SEQ ID NO: 16176 - DNA, 23 bp, Artificial Sequence
  Synthetic construct
gcaccgttggagaatgtgcattg

SEQ ID NO: 16177 - DNA, 23 bp, Artificial Sequence
  Synthetic construct
gcaccgttggagaacatgcattg

SEQ ID NO: 16178 - DNA, 23 bp, Artificial Sequence
  Synthetic construct
gcaccgttggagaacctgcattg

SEQ ID NO: 16179 - DNA, 23 bp, Artificial Sequence
  Synthetic construct
gcaccgttggagaacttgcattg

SEQ ID NO: 16180 - DNA, 23 bp, Artificial Sequence
  Synthetic construct
gcaccgttggagaacgagcattg

SEQ ID NO: 16181 - DNA, 23 bp, Artificial Sequence
  Synthetic construct
gcaccgttggagaacgcgcattg

SEQ ID NO: 16182 - DNA, 23 bp, Artificial Sequence
  Synthetic construct
gcaccgttggagaacgggcattg

SEQ ID NO: 16183 - DNA, 23 bp, Artificial Sequence
  Synthetic construct
gcaccgttggagaacgtacattg

SEQ ID NO: 16184 - DNA, 23 bp, Artificial Sequence
  Synthetic construct
gcaccgttggagaacgtccattg

SEQ ID NO: 16185 - DNA, 23 bp, Artificial Sequence
  Synthetic construct
gcaccgttggagaacgttcattg

SEQ ID NO: 16186 - DNA, 23 bp, Artificial Sequence
  Synthetic construct
gcaccgttggagaacgtgaattg

SEQ ID NO: 16187 - DNA, 23 bp, Artificial Sequence
  Synthetic construct
gcaccgttggagaacgtggattg

SEQ ID NO: 16188 - DNA, 23 bp, Artificial Sequence
  Synthetic construct
gcaccgttggagaacgtgtattg

SEQ ID NO: 16189 - DNA, 23 bp, Artificial Sequence
  Synthetic construct
gcaccgttggagaacgtgccttg

SEQ ID NO: 16190 - DNA, 23 bp, Artificial Sequence
  Synthetic construct
gcaccgttggagaacgtgcgttg

SEQ ID NO: 16191 - DNA, 23 bp, Artificial Sequence
  Synthetic construct
gcaccgttggagaacgtgctttg

SEQ ID NO: 16192 - DNA, 23 bp, Artificial Sequence
  Synthetic construct
gcaccgttggagaacgtgcaatg

SEQ ID NO: 16193 - DNA, 23 bp, Artificial Sequence
  Synthetic construct
gcaccgttggagaacgtgcactg

SEQ ID NO: 16194 - DNA, 23 bp, Artificial Sequence
  Synthetic construct
gcaccgttggagaacgtgcagtg

SEQ ID NO: 16195 - DNA, 23 bp, Artificial Sequence
  Synthetic construct
gcaccgttggagaacgtgcatag

SEQ ID NO: 16196 - DNA, 23 bp, Artificial Sequence
  Synthetic construct
gcaccgttggagaacgtgcatcg

SEQ ID NO: 16197 - DNA, 23 bp, Artificial Sequence
  Synthetic construct
gcaccgttggagaacgtgcatgg

SEQ ID NO: 16198 - DNA, 23 bp, Artificial Sequence
  Synthetic construct
gcaccgttggagaacgtgcatta

SEQ ID NO: 16199 - DNA, 23 bp, Artificial Sequence
  Synthetic construct
gcaccgttggagaacgtgcattc

SEQ ID NO: 16200 - DNA, 23 bp, Artificial Sequence
  Synthetic construct
gcaccgttggagaacgtgcattt

SEQ ID NO: 16201 - DNA, 22 bp, Artificial Sequence
  Synthetic construct
agcgattgctgagggaatcggg

SEQ ID NO: 16202 - DNA, 22 bp, Artificial Sequence
  Synthetic construct
cgcgattgctgagggaatcggg

SEQ ID NO: 16203 - DNA, 22 bp, Artificial Sequence
  Synthetic construct
ggcgattgctgagggaatcggg

SEQ ID NO: 16204 - DNA, 22 bp, Artificial Sequence
  Synthetic construct
tacgattgctgagggaatcggg

SEQ ID NO: 16205 - DNA, 22 bp, Artificial Sequence
  Synthetic construct
tccgattgctgagggaatcggg

SEQ ID NO: 16206 - DNA, 22 bp, Artificial Sequence
  Synthetic construct
ttcgattgctgagggaatcggg

SEQ ID NO: 16207 - DNA, 22 bp, Artificial Sequence
  Synthetic construct
tgagattgctgagggaatcggg

SEQ ID NO: 16208 - DNA, 22 bp, Artificial Sequence
  Synthetic construct
tgggattgctgagggaatcggg

SEQ ID NO: 16209 - DNA, 22 bp, Artificial Sequence
  Synthetic construct
tgtgattgctgagggaatcggg

SEQ ID NO: 16210 - DNA, 22 bp, Artificial Sequence
  Synthetic construct
tgcaattgctgagggaatcggg

SEQ ID NO: 16211 - DNA, 22 bp, Artificial Sequence
  Synthetic construct
tgccattgctgagggaatcggg

SEQ ID NO: 16212 - DNA, 22 bp, Artificial Sequence
  Synthetic construct
tgctattgctgagggaatcggg

SEQ ID NO: 16213 - DNA, 22 bp, Artificial Sequence
  Synthetic construct
tgcgcttgctgagggaatcggg

SEQ ID NO: 16214 - DNA, 22 bp, Artificial Sequence
  Synthetic construct
tgcggttgctgagggaatcggg

SEQ ID NO: 16215 - DNA, 22 bp, Artificial Sequence
  Synthetic construct
tgcgtttgctgagggaatcggg

SEQ ID NO: 16216 - DNA, 22 bp, Artificial Sequence
  Synthetic construct
tgcgaatgctgagggaatcggg

SEQ ID NO: 16217 - DNA, 22 bp, Artificial Sequence
  Synthetic construct
tgcgactgctgagggaatcggg

SEQ ID NO: 16218 - DNA, 22 bp, Artificial Sequence
  Synthetic construct
tgcgagtgctgagggaatcggg

SEQ ID NO: 16219 - DNA, 22 bp, Artificial Sequence
  Synthetic construct
tgcgatagctgagggaatcggg

SEQ ID NO: 16220 - DNA, 22 bp, Artificial Sequence
  Synthetic construct
tgcgatcgctgagggaatcggg

SEQ ID NO: 16221 - DNA, 22 bp, Artificial Sequence
  Synthetic construct
tgcgatggctgagggaatcggg

SEQ ID NO: 16222 - DNA, 22 bp, Artificial Sequence
  Synthetic construct
tgcgattactgagggaatcggg

SEQ ID NO: 16223 - DNA, 22 bp, Artificial Sequence
  Synthetic construct
tgcgattcctgagggaatcggg

SEQ ID NO: 16224 - DNA, 22 bp, Artificial Sequence
  Synthetic construct
tgcgatttctgagggaatcggg

SEQ ID NO: 16225 - DNA, 22 bp, Artificial Sequence
  Synthetic construct
tgcgattgatgagggaatcggg

SEQ ID NO: 16226 - DNA, 22 bp, Artificial Sequence
  Synthetic construct
tgcgattggtgagggaatcggg

SEQ ID NO: 16227 - DNA, 22 bp, Artificial Sequence
  Synthetic construct
tgcgattgttgagggaatcggg

SEQ ID NO: 16228 - DNA, 22 bp, Artificial Sequence
  Synthetic construct
tgcgattgcagagggaatcggg

SEQ ID NO: 16229 - DNA, 22 bp, Artificial Sequence
  Synthetic construct
tgcgattgccgagggaatcggg

SEQ ID NO: 16230 - DNA, 22 bp, Artificial Sequence
  Synthetic construct
tgcgattgcggagggaatcggg

SEQ ID NO: 16231 - DNA, 22 bp, Artificial Sequence
  Synthetic construct
tgcgattgctaagggaatcggg

SEQ ID NO: 16232 - DNA, 22 bp, Artificial Sequence
  Synthetic construct
tgcgattgctcagggaatcggg

SEQ ID NO: 16233 - DNA, 22 bp, Artificial Sequence
  Synthetic construct
tgcgattgcttagggaatcggg

SEQ ID NO: 16234 - DNA, 22 bp, Artificial Sequence
  Synthetic construct
tgcgattgctgcgggaatcggg

SEQ ID NO: 16235 - DNA, 22 bp, Artificial Sequence
  Synthetic construct
tgcgattgctgggggaatcggg

SEQ ID NO: 16236 - DNA, 22 bp, Artificial Sequence
  Synthetic construct
tgcgattgctgtgggaatcggg

SEQ ID NO: 16237 - DNA, 22 bp, Artificial Sequence
  Synthetic construct
tgcgattgctgaaggaatcggg

SEQ ID NO: 16238 - DNA, 22 bp, Artificial Sequence
  Synthetic construct
tgcgattgctgacggaatcggg

SEQ ID NO: 16239 - DNA, 22 bp, Artificial Sequence
  Synthetic construct
tgcgattgctgatggaatcggg

SEQ ID NO: 16240 - DNA, 22 bp, Artificial Sequence
  Synthetic construct
tgcgattgctgagagaatcggg

SEQ ID NO: 16241 - DNA, 22 bp, Artificial Sequence
  Synthetic construct
tgcgattgctgagcgaatcggg

SEQ ID NO: 16242 - DNA, 22 bp, Artificial Sequence
  Synthetic construct
tgcgattgctgagtgaatcggg

SEQ ID NO: 16243 - DNA, 22 bp, Artificial Sequence
  Synthetic construct
tgcgattgctgaggaaatcggg

SEQ ID NO: 16244 - DNA, 22 bp, Artificial Sequence
  Synthetic construct
tgcgattgctgaggcaatcggg

SEQ ID NO: 16245 - DNA, 22 bp, Artificial Sequence
  Synthetic construct
tgcgattgctgaggtaatcggg

SEQ ID NO: 16246 - DNA, 22 bp, Artificial Sequence
  Synthetic construct
tgcgattgctgagggcatcggg

SEQ ID NO: 16247 - DNA, 22 bp, Artificial Sequence
  Synthetic construct
tgcgattgctgaggggatcggg

SEQ ID NO: 16248 - DNA, 22 bp, Artificial Sequence
  Synthetic construct
tgcgattgctgagggtatcggg

SEQ ID NO: 16249 - DNA, 22 bp, Artificial Sequence
  Synthetic construct
tgcgattgctgagggactcggg

SEQ ID NO: 16250 - DNA, 22 bp, Artificial Sequence
  Synthetic construct
tgcgattgctgagggagtcggg

SEQ ID NO: 16251 - DNA, 22 bp, Artificial Sequence
  Synthetic construct
tgcgattgctgagggattcggg

SEQ ID NO: 16252 - DNA, 22 bp, Artificial Sequence
  Synthetic construct
tgcgattgctgagggaaacggg

SEQ ID NO: 16253 - DNA, 22 bp, Artificial Sequence
  Synthetic construct
tgcgattgctgagggaaccggg

SEQ ID NO: 16254 - DNA, 22 bp, Artificial Sequence
  Synthetic construct
tgcgattgctgagggaagcggg

SEQ ID NO: 16255 - DNA, 22 bp, Artificial Sequence
  Synthetic construct
tgcgattgctgagggaataggg

SEQ ID NO: 16256 - DNA, 22 bp, Artificial Sequence
  Synthetic construct
tgcgattgctgagggaatgggg

SEQ ID NO: 16257 - DNA, 22 bp, Artificial Sequence
  Synthetic construct
tgcgattgctgagggaattggg

SEQ ID NO: 16258 - DNA, 22 bp, Artificial Sequence
  Synthetic construct
tgcgattgctgagggaatcagg

SEQ ID NO: 16259 - DNA, 22 bp, Artificial Sequence
  Synthetic construct
tgcgattgctgagggaatccgg

SEQ ID NO: 16260 - DNA, 22 bp, Artificial Sequence
  Synthetic construct
tgcgattgctgagggaatctgg

SEQ ID NO: 16261 - DNA, 22 bp, Artificial Sequence
  Synthetic construct
tgcgattgctgagggaatcgag

SEQ ID NO: 16262 - DNA, 22 bp, Artificial Sequence
  Synthetic construct
tgcgattgctgagggaatcgcg

SEQ ID NO: 16263 - DNA, 22 bp, Artificial Sequence
  Synthetic construct
tgcgattgctgagggaatcgtg

SEQ ID NO: 16264 - DNA, 22 bp, Artificial Sequence
  Synthetic construct
tgcgattgctgagggaatcgga

SEQ ID NO: 16265 - DNA, 22 bp, Artificial Sequence
  Synthetic construct
tgcgattgctgagggaatcggc

SEQ ID NO: 16266 - DNA, 22 bp, Artificial Sequence
  Synthetic construct
tgcgattgctgagggaatcggt

SEQ ID NO: 16267 - DNA, 22 bp, Artificial Sequence
  Synthetic construct
ctgaaagcaccgacccctttct

SEQ ID NO: 16268 - DNA, 22 bp, Artificial Sequence
  Synthetic construct
gtgaaagcaccgacccctttct

SEQ ID NO: 16269 - DNA, 22 bp, Artificial Sequence
  Synthetic construct
ttgaaagcaccgacccctttct

SEQ ID NO: 16270 - DNA, 22 bp, Artificial Sequence
  Synthetic construct
aagaaagcaccgacccctttct

SEQ ID NO: 16271 - DNA, 22 bp, Artificial Sequence
  Synthetic construct
acgaaagcaccgacccctttct

SEQ ID NO: 16272 - DNA, 22 bp, Artificial Sequence
  Synthetic construct
aggaaagcaccgacccctttct

SEQ ID NO: 16273 - DNA, 22 bp, Artificial Sequence
  Synthetic construct
ataaaagcaccgacccctttct

SEQ ID NO: 16274 - DNA, 22 bp, Artificial Sequence
  Synthetic construct
atcaaagcaccgacccctttct

SEQ ID NO: 16275 - DNA, 22 bp, Artificial Sequence
  Synthetic construct
attaaagcaccgacccctttct

SEQ ID NO: 16276 - DNA, 22 bp, Artificial Sequence
  Synthetic construct
atgcaagcaccgacccctttct

SEQ ID NO: 16277 - DNA, 22 bp, Artificial Sequence
  Synthetic construct
atggaagcaccgacccctttct

SEQ ID NO: 16278 - DNA, 22 bp, Artificial Sequence
  Synthetic construct
atgtaagcaccgacccctttct

SEQ ID NO: 16279 - DNA, 22 bp, Artificial Sequence
  Synthetic construct
atgacagcaccgacccctttct

SEQ ID NO: 16280 - DNA, 22 bp, Artificial Sequence
  Synthetic construct
atgagagcaccgacccctttct

SEQ ID NO: 16281 - DNA, 22 bp, Artificial Sequence
  Synthetic construct
atgatagcaccgacccctttct

SEQ ID NO: 16282 - DNA, 22 bp, Artificial Sequence
  Synthetic construct
atgaacgcaccgacccctttct

SEQ ID NO: 16283 - DNA, 22 bp, Artificial Sequence
  Synthetic construct
atgaaggcaccgacccctttct

SEQ ID NO: 16284 - DNA, 22 bp, Artificial Sequence
  Synthetic construct
atgaatgcaccgacccctttct

SEQ ID NO: 16285 - DNA, 22 bp, Artificial Sequence
  Synthetic construct
atgaaaacaccgacccctttct

SEQ ID NO: 16286 - DNA, 22 bp, Artificial Sequence
  Synthetic construct
atgaaaccaccgacccctttct

SEQ ID NO: 16287 - DNA, 22 bp, Artificial Sequence
  Synthetic construct
atgaaatcaccgacccctttct

SEQ ID NO: 16288 - DNA, 22 bp, Artificial Sequence
  Synthetic construct
atgaaagaaccgacccctttct

SEQ ID NO: 16289 - DNA, 22 bp, Artificial Sequence
  Synthetic construct
atgaaaggaccgacccctttct

SEQ ID NO: 16290 - DNA, 22 bp, Artificial Sequence
  Synthetic construct
atgaaagtaccgacccctttct

SEQ ID NO: 16291 - DNA, 22 bp, Artificial Sequence
  Synthetic construct
atgaaagccccgacccctttct

SEQ ID NO: 16292 - DNA, 22 bp, Artificial Sequence
  Synthetic construct
atgaaagcgccgacccctttct

SEQ ID NO: 16293 - DNA, 22 bp, Artificial Sequence
  Synthetic construct
atgaaagctccgacccctttct

SEQ ID NO: 16294 - DNA, 22 bp, Artificial Sequence
  Synthetic construct
atgaaagcaacgacccctttct

SEQ ID NO: 16295 - DNA, 22 bp, Artificial Sequence
  Synthetic construct
atgaaagcagcgacccctttct

SEQ ID NO: 16296 - DNA, 22 bp, Artificial Sequence
  Synthetic construct
atgaaagcatcgacccctttct

SEQ ID NO: 16297 - DNA, 22 bp, Artificial Sequence
  Synthetic construct
atgaaagcacagacccctttct

SEQ ID NO: 16298 - DNA, 22 bp, Artificial Sequence
  Synthetic construct
atgaaagcacggacccctttct

SEQ ID NO: 16299 - DNA, 22 bp, Artificial Sequence
  Synthetic construct
atgaaagcactgacccctttct

SEQ ID NO: 16300 - DNA, 22 bp, Artificial Sequence
  Synthetic construct
atgaaagcaccaacccctttct

SEQ ID NO: 16301 - DNA, 22 bp, Artificial Sequence
  Synthetic construct
atgaaagcacccacccctttct

SEQ ID NO: 16302 - DNA, 22 bp, Artificial Sequence
  Synthetic construct
atgaaagcacctacccctttct

SEQ ID NO: 16303 - DNA, 22 bp, Artificial Sequence
  Synthetic construct
atgaaagcaccgccccctttct

SEQ ID NO: 16304 - DNA, 22 bp, Artificial Sequence
  Synthetic construct
atgaaagcaccggcccctttct

SEQ ID NO: 16305 - DNA, 22 bp, Artificial Sequence
  Synthetic construct
atgaaagcaccgtcccctttct

SEQ ID NO: 16306 - DNA, 22 bp, Artificial Sequence
  Synthetic construct
atgaaagcaccgaaccctttct

SEQ ID NO: 16307 - DNA, 22 bp, Artificial Sequence
  Synthetic construct
atgaaagcaccgagccctttct

SEQ ID NO: 16308 - DNA, 22 bp, Artificial Sequence
  Synthetic construct
atgaaagcaccgatccctttct

SEQ ID NO: 16309 - DNA, 22 bp, Artificial Sequence
  Synthetic construct
atgaaagcaccgacacctttct

SEQ ID NO: 16310 - DNA, 22 bp, Artificial Sequence
  Synthetic construct
atgaaagcaccgacgcctttct

SEQ ID NO: 16311 - DNA, 22 bp, Artificial Sequence
  Synthetic construct
atgaaagcaccgactcctttct

SEQ ID NO: 16312 - DNA, 22 bp, Artificial Sequence
  Synthetic construct
atgaaagcaccgaccactttct

SEQ ID NO: 16313 - DNA, 22 bp, Artificial Sequence
  Synthetic construct
atgaaagcaccgaccgctttct

SEQ ID NO: 16314 - DNA, 22 bp, Artificial Sequence
  Synthetic construct
atgaaagcaccgacctctttct

SEQ ID NO: 16315 - DNA, 22 bp, Artificial Sequence
  Synthetic construct
atgaaagcaccgacccatttct

SEQ ID NO: 16316 - DNA, 22 bp, Artificial Sequence
  Synthetic construct
atgaaagcaccgacccgtttct

SEQ ID NO: 16317 - DNA, 22 bp, Artificial Sequence
  Synthetic construct
atgaaagcaccgacccttttct

SEQ ID NO: 16318 - DNA, 22 bp, Artificial Sequence
  Synthetic construct
atgaaagcaccgaccccattct

SEQ ID NO: 16319 - DNA, 22 bp, Artificial Sequence
  Synthetic construct
atgaaagcaccgacccccttct

SEQ ID NO: 16320 - DNA, 22 bp, Artificial Sequence
  Synthetic construct
atgaaagcaccgaccccgttct

SEQ ID NO: 16321 - DNA, 22 bp, Artificial Sequence
  Synthetic construct
atgaaagcaccgacccctatct

SEQ ID NO: 16322 - DNA, 22 bp, Artificial Sequence
  Synthetic construct
atgaaagcaccgacccctctct

SEQ ID NO: 16323 - DNA, 22 bp, Artificial Sequence
  Synthetic construct
atgaaagcaccgacccctgtct

SEQ ID NO: 16324 - DNA, 22 bp, Artificial Sequence
  Synthetic construct
atgaaagcaccgaccccttact

SEQ ID NO: 16325 - DNA, 22 bp, Artificial Sequence
  Synthetic construct
atgaaagcaccgaccccttcct

SEQ ID NO: 16326 - DNA, 22 bp, Artificial Sequence
  Synthetic construct
atgaaagcaccgaccccttgct

SEQ ID NO: 16327 - DNA, 22 bp, Artificial Sequence
  Synthetic construct
atgaaagcaccgacccctttat

SEQ ID NO: 16328 - DNA, 22 bp, Artificial Sequence
  Synthetic construct
atgaaagcaccgacccctttgt

SEQ ID NO: 16329 - DNA, 22 bp, Artificial Sequence
  Synthetic construct
atgaaagcaccgaccccttttt

SEQ ID NO: 16330 - DNA, 22 bp, Artificial Sequence
  Synthetic construct
atgaaagcaccgacccctttca

SEQ ID NO: 16331 - DNA, 22 bp, Artificial Sequence
  Synthetic construct
atgaaagcaccgacccctttcc

SEQ ID NO: 16332 - DNA, 22 bp, Artificial Sequence
  Synthetic construct
atgaaagcaccgacccctttcg

SEQ ID NO: 16333 - DNA, 23 bp, Artificial Sequence
  Synthetic construct
acatctaaggtatggaccatcga

SEQ ID NO: 16334 - DNA, 23 bp, Artificial Sequence
  Synthetic construct
ccatctaaggtatggaccatcga

SEQ ID NO: 16335 - DNA, 23 bp, Artificial Sequence
  Synthetic construct
tcatctaaggtatggaccatcga

SEQ ID NO: 16336 - DNA, 23 bp, Artificial Sequence
  Synthetic construct
gaatctaaggtatggaccatcga

SEQ ID NO: 16337 - DNA, 23 bp, Artificial Sequence
  Synthetic construct
ggatctaaggtatggaccatcga

SEQ ID NO: 16338 - DNA, 23 bp, Artificial Sequence
  Synthetic construct
gtatctaaggtatggaccatcga

SEQ ID NO: 16339 - DNA, 23 bp, Artificial Sequence
  Synthetic construct
gcctctaaggtatggaccatcga

SEQ ID NO: 16340 - DNA, 23 bp, Artificial Sequence
  Synthetic construct
gcgtctaaggtatggaccatcga

SEQ ID NO: 16341 - DNA, 23 bp, Artificial Sequence
  Synthetic construct
gcttctaaggtatggaccatcga

SEQ ID NO: 16342 - DNA, 23 bp, Artificial Sequence
  Synthetic construct
gcaactaaggtatggaccatcga

SEQ ID NO: 16343 - DNA, 23 bp, Artificial Sequence
  Synthetic construct
gcacctaaggtatggaccatcga

SEQ ID NO: 16344 - DNA, 23 bp, Artificial Sequence
  Synthetic construct
gcagctaaggtatggaccatcga

SEQ ID NO: 16345 - DNA, 23 bp, Artificial Sequence
  Synthetic construct
gcatataaggtatggaccatcga

SEQ ID NO: 16346 - DNA, 23 bp, Artificial Sequence
  Synthetic construct
gcatgtaaggtatggaccatcga

SEQ ID NO: 16347 - DNA, 23 bp, Artificial Sequence
  Synthetic construct
gcatttaaggtatggaccatcga

SEQ ID NO: 16348 - DNA, 23 bp, Artificial Sequence
  Synthetic construct
gcatcaaaggtatggaccatcga

SEQ ID NO: 16349 - DNA, 23 bp, Artificial Sequence
  Synthetic construct
gcatccaaggtatggaccatcga

SEQ ID NO: 16350 - DNA, 23 bp, Artificial Sequence
  Synthetic construct
gcatcgaaggtatggaccatcga

SEQ ID NO: 16351 - DNA, 23 bp, Artificial Sequence
  Synthetic construct
gcatctcaggtatggaccatcga

SEQ ID NO: 16352 - DNA, 23 bp, Artificial Sequence
  Synthetic construct
gcatctgaggtatggaccatcga

SEQ ID NO: 16353 - DNA, 23 bp, Artificial Sequence
  Synthetic construct
gcatcttaggtatggaccatcga

SEQ ID NO: 16354 - DNA, 23 bp, Artificial Sequence
  Synthetic construct
gcatctacggtatggaccatcga

SEQ ID NO: 16355 - DNA, 23 bp, Artificial Sequence
  Synthetic construct
gcatctagggtatggaccatcga

SEQ ID NO: 16356 - DNA, 23 bp, Artificial Sequence
  Synthetic construct
gcatctatggtatggaccatcga

SEQ ID NO: 16357 - DNA, 23 bp, Artificial Sequence
  Synthetic construct
gcatctaaagtatggaccatcga

SEQ ID NO: 16358 - DNA, 23 bp, Artificial Sequence
  Synthetic construct
gcatctaacgtatggaccatcga

SEQ ID NO: 16359 - DNA, 23 bp, Artificial Sequence
  Synthetic construct
gcatctaatgtatggaccatcga

SEQ ID NO: 16360 - DNA, 23 bp, Artificial Sequence
  Synthetic construct
gcatctaagatatggaccatcga

SEQ ID NO: 16361 - DNA, 23 bp, Artificial Sequence
  Synthetic construct
gcatctaagctatggaccatcga

SEQ ID NO: 16362 - DNA, 23 bp, Artificial Sequence
  Synthetic construct
gcatctaagttatggaccatcga

SEQ ID NO: 16363 - DNA, 23 bp, Artificial Sequence
  Synthetic construct
gcatctaaggaatggaccatcga

SEQ ID NO: 16364 - DNA, 23 bp, Artificial Sequence
  Synthetic construct
gcatctaaggcatggaccatcga

SEQ ID NO: 16365 - DNA, 23 bp, Artificial Sequence
  Synthetic construct
gcatctaagggatggaccatcga

SEQ ID NO: 16366 - DNA, 23 bp, Artificial Sequence
  Synthetic construct
gcatctaaggtctggaccatcga

SEQ ID NO: 16367 - DNA, 23 bp, Artificial Sequence
  Synthetic construct
gcatctaaggtgtggaccatcga

SEQ ID NO: 16368 - DNA, 23 bp, Artificial Sequence
  Synthetic construct
gcatctaaggtttggaccatcga

SEQ ID NO: 16369 - DNA, 23 bp, Artificial Sequence
  Synthetic construct
gcatctaaggtaaggaccatcga

SEQ ID NO: 16370 - DNA, 23 bp, Artificial Sequence
  Synthetic construct
gcatctaaggtacggaccatcga

SEQ ID NO: 16371 - DNA, 23 bp, Artificial Sequence
  Synthetic construct
gcatctaaggtagggaccatcga

SEQ ID NO: 16372 - DNA, 23 bp, Artificial Sequence
  Synthetic construct
gcatctaaggtatagaccatcga

SEQ ID NO: 16373 - DNA, 23 bp, Artificial Sequence
  Synthetic construct
gcatctaaggtatcgaccatcga

SEQ ID NO: 16374 - DNA, 23 bp, Artificial Sequence
  Synthetic construct
gcatctaaggtattgaccatcga

SEQ ID NO: 16375 - DNA, 23 bp, Artificial Sequence
  Synthetic construct
gcatctaaggtatgaaccatcga

SEQ ID NO: 16376 - DNA, 23 bp, Artificial Sequence
  Synthetic construct
gcatctaaggtatgcaccatcga

SEQ ID NO: 16377 - DNA, 23 bp, Artificial Sequence
  Synthetic construct
gcatctaaggtatgtaccatcga

SEQ ID NO: 16378 - DNA, 23 bp, Artificial Sequence
  Synthetic construct
gcatctaaggtatggcccatcga

SEQ ID NO: 16379 - DNA, 23 bp, Artificial Sequence
  Synthetic construct
gcatctaaggtatgggccatcga

SEQ ID NO: 16380 - DNA, 23 bp, Artificial Sequence
  Synthetic construct
gcatctaaggtatggtccatcga

SEQ ID NO: 16381 - DNA, 23 bp, Artificial Sequence
  Synthetic construct
gcatctaaggtatggaacatcga

SEQ ID NO: 16382 - DNA, 23 bp, Artificial Sequence
  Synthetic construct
gcatctaaggtatggagcatcga

SEQ ID NO: 16383 - DNA, 23 bp, Artificial Sequence
  Synthetic construct
gcatctaaggtatggatcatcga

SEQ ID NO: 16384 - DNA, 23 bp, Artificial Sequence
  Synthetic construct
gcatctaaggtatggacaatcga

SEQ ID NO: 16385 - DNA, 23 bp, Artificial Sequence
  Synthetic construct
gcatctaaggtatggacgatcga

SEQ ID NO: 16386 - DNA, 23 bp, Artificial Sequence
  Synthetic construct
gcatctaaggtatggactatcga

SEQ ID NO: 16387 - DNA, 23 bp, Artificial Sequence
  Synthetic construct
gcatctaaggtatggaccctcga

SEQ ID NO: 16388 - DNA, 23 bp, Artificial Sequence
  Synthetic construct
gcatctaaggtatggaccgtcga

SEQ ID NO: 16389 - DNA, 23 bp, Artificial Sequence
  Synthetic construct
gcatctaaggtatggaccttcga

SEQ ID NO: 16390 - DNA, 23 bp, Artificial Sequence
  Synthetic construct
gcatctaaggtatggaccaacga

SEQ ID NO: 16391 - DNA, 23 bp, Artificial Sequence
  Synthetic construct
gcatctaaggtatggaccaccga

SEQ ID NO: 16392 - DNA, 23 bp, Artificial Sequence
  Synthetic construct
gcatctaaggtatggaccagcga

SEQ ID NO: 16393 - DNA, 23 bp, Artificial Sequence
  Synthetic construct
gcatctaaggtatggaccataga

SEQ ID NO: 16394 - DNA, 23 bp, Artificial Sequence
  Synthetic construct
gcatctaaggtatggaccatgga

SEQ ID NO: 16395 - DNA, 23 bp, Artificial Sequence
  Synthetic construct
gcatctaaggtatggaccattga

SEQ ID NO: 16396 - DNA, 23 bp, Artificial Sequence
  Synthetic construct
gcatctaaggtatggaccatcaa

SEQ ID NO: 16397 - DNA, 23 bp, Artificial Sequence
  Synthetic construct
gcatctaaggtatggaccatcca

SEQ ID NO: 16398 - DNA, 23 bp, Artificial Sequence
  Synthetic construct
gcatctaaggtatggaccatcta

SEQ ID NO: 16399 - DNA, 23 bp, Artificial Sequence
  Synthetic construct
gcatctaaggtatggaccatcgc

SEQ ID NO: 16400 - DNA, 23 bp, Artificial Sequence
  Synthetic construct
gcatctaaggtatggaccatcgg

SEQ ID NO: 16401 - DNA, 23 bp, Artificial Sequence
  Synthetic construct
gcatctaaggtatggaccatcgt

SEQ ID NO: 16402 - DNA, 20 bp, Artificial Sequence
  Synthetic construct
ctgccggagtttgctgcgat

SEQ ID NO: 16403 - DNA, 20 bp, Artificial Sequence
  Synthetic construct
gtgccggagtttgctgcgat

SEQ ID NO: 16404 - DNA, 20 bp, Artificial Sequence
  Synthetic construct
ttgccggagtttgctgcgat

SEQ ID NO: 16405 - DNA, 20 bp, Artificial Sequence
  Synthetic construct
aagccggagtttgctgcgat

SEQ ID NO: 16406 - DNA, 20 bp, Artificial Sequence
  Synthetic construct
acgccggagtttgctgcgat

SEQ ID NO: 16407 - DNA, 20 bp, Artificial Sequence
  Synthetic construct
aggccggagtttgctgcgat

SEQ ID NO: 16408 - DNA, 20 bp, Artificial Sequence
  Synthetic construct
ataccggagtttgctgcgat

SEQ ID NO: 16409 - DNA, 20 bp, Artificial Sequence
  Synthetic construct
atcccggagtttgctgcgat

SEQ ID NO: 16410 - DNA, 20 bp, Artificial Sequence
  Synthetic construct
attccggagtttgctgcgat

SEQ ID NO: 16411 - DNA, 20 bp, Artificial Sequence
  Synthetic construct
atgacggagtttgctgcgat

SEQ ID NO: 16412 - DNA, 20 bp, Artificial Sequence
  Synthetic construct
atggcggagtttgctgcgat

SEQ ID NO: 16413 - DNA, 20 bp, Artificial Sequence
  Synthetic construct
atgtcggagtttgctgcgat

SEQ ID NO: 16414 - DNA, 20 bp, Artificial Sequence
  Synthetic construct
atgcaggagtttgctgcgat

SEQ ID NO: 16415 - DNA, 20 bp, Artificial Sequence
  Synthetic construct
atgcgggagtttgctgcgat

SEQ ID NO: 16416 - DNA, 20 bp, Artificial Sequence
  Synthetic construct
atgctggagtttgctgcgat

SEQ ID NO: 16417 - DNA, 20 bp, Artificial Sequence
  Synthetic construct
atgccagagtttgctgcgat

SEQ ID NO: 16418 - DNA, 20 bp, Artificial Sequence
  Synthetic construct
atgcccgagtttgctgcgat

SEQ ID NO: 16419 - DNA, 20 bp, Artificial Sequence
  Synthetic construct
atgcctgagtttgctgcgat

SEQ ID NO: 16420 - DNA, 20 bp, Artificial Sequence
  Synthetic construct
atgccgaagtttgctgcgat

SEQ ID NO: 16421 - DNA, 20 bp, Artificial Sequence
  Synthetic construct
atgccgcagtttgctgcgat

SEQ ID NO: 16422 - DNA, 20 bp, Artificial Sequence
  Synthetic construct
atgccgtagtttgctgcgat

SEQ ID NO: 16423 - DNA, 20 bp, Artificial Sequence
  Synthetic construct
atgccggcgtttgctgcgat

SEQ ID NO: 16424 - DNA, 20 bp, Artificial Sequence
  Synthetic construct
atgccggggtttgctgcgat

SEQ ID NO: 16425 - DNA, 20 bp, Artificial Sequence
  Synthetic construct
atgccggtgtttgctgcgat

SEQ ID NO: 16426 - DNA, 20 bp, Artificial Sequence
  Synthetic construct
atgccggaatttgctgcgat

SEQ ID NO: 16427 - DNA, 20 bp, Artificial Sequence
  Synthetic construct
atgccggactttgctgcgat

SEQ ID NO: 16428 - DNA, 20 bp, Artificial Sequence
  Synthetic construct
atgccggattttgctgcgat

SEQ ID NO: 16429 - DNA, 20 bp, Artificial Sequence
  Synthetic construct
atgccggagattgctgcgat

SEQ ID NO: 16430 - DNA, 20 bp, Artificial Sequence
  Synthetic construct
atgccggagcttgctgcgat

SEQ ID NO: 16431 - DNA, 20 bp, Artificial Sequence
  Synthetic construct
atgccggaggttgctgcgat

SEQ ID NO: 16432 - DNA, 20 bp, Artificial Sequence
  Synthetic construct
atgccggagtatgctgcgat

SEQ ID NO: 16433 - DNA, 20 bp, Artificial Sequence
  Synthetic construct
atgccggagtctgctgcgat

SEQ ID NO: 16434 - DNA, 20 bp, Artificial Sequence
  Synthetic construct
atgccggagtgtgctgcgat

SEQ ID NO: 16435 - DNA, 20 bp, Artificial Sequence
  Synthetic construct
atgccggagttagctgcgat

SEQ ID NO: 16436 - DNA, 20 bp, Artificial Sequence
  Synthetic construct
atgccggagttcgctgcgat

SEQ ID NO: 16437 - DNA, 20 bp, Artificial Sequence
  Synthetic construct
atgccggagttggctgcgat

SEQ ID NO: 16438 - DNA, 20 bp, Artificial Sequence
  Synthetic construct
atgccggagtttactgcgat

SEQ ID NO: 16439 - DNA, 20 bp, Artificial Sequence
  Synthetic construct
atgccggagtttcctgcgat

SEQ ID NO: 16440 - DNA, 20 bp, Artificial Sequence
  Synthetic construct
atgccggagttttctgcgat

SEQ ID NO: 16441 - DNA, 20 bp, Artificial Sequence
  Synthetic construct
atgccggagtttgatgcgat

SEQ ID NO: 16442 - DNA, 20 bp, Artificial Sequence
  Synthetic construct
atgccggagtttggtgcgat

SEQ ID NO: 16443 - DNA, 20 bp, Artificial Sequence
  Synthetic construct
atgccggagtttgttgcgat

SEQ ID NO: 16444 - DNA, 20 bp, Artificial Sequence
  Synthetic construct
atgccggagtttgcagcgat

SEQ ID NO: 16445 - DNA, 20 bp, Artificial Sequence
  Synthetic construct
atgccggagtttgccgcgat

SEQ ID NO: 16446 - DNA, 20 bp, Artificial Sequence
  Synthetic construct
atgccggagtttgcggcgat

SEQ ID NO: 16447 - DNA, 20 bp, Artificial Sequence
  Synthetic construct
atgccggagtttgctacgat

SEQ ID NO: 16448 - DNA, 20 bp, Artificial Sequence
  Synthetic construct
atgccggagtttgctccgat

SEQ ID NO: 16449 - DNA, 20 bp, Artificial Sequence
  Synthetic construct
atgccggagtttgcttcgat

SEQ ID NO: 16450 - DNA, 20 bp, Artificial Sequence
  Synthetic construct
atgccggagtttgctgagat

SEQ ID NO: 16451 - DNA, 20 bp, Artificial Sequence
  Synthetic construct
atgccggagtttgctgggat

SEQ ID NO: 16452 - DNA, 20 bp, Artificial Sequence
  Synthetic construct
atgccggagtttgctgtgat

SEQ ID NO: 16453 - DNA, 20 bp, Artificial Sequence
  Synthetic construct
atgccggagtttgctgcaat

SEQ ID NO: 16454 - DNA, 20 bp, Artificial Sequence
  Synthetic construct
atgccggagtttgctgccat

SEQ ID NO: 16455 - DNA, 20 bp, Artificial Sequence
  Synthetic construct
atgccggagtttgctgctat

SEQ ID NO: 16456 - DNA, 20 bp, Artificial Sequence
  Synthetic construct
atgccggagtttgctgcgct

SEQ ID NO: 16457 - DNA, 20 bp, Artificial Sequence
  Synthetic construct
atgccggagtttgctgcggt

SEQ ID NO: 16458 - DNA, 20 bp, Artificial Sequence
  Synthetic construct
atgccggagtttgctgcgtt

SEQ ID NO: 16459 - DNA, 20 bp, Artificial Sequence
  Synthetic construct
atgccggagtttgctgcgaa

SEQ ID NO: 16460 - DNA, 20 bp, Artificial Sequence
  Synthetic construct
atgccggagtttgctgcgac

SEQ ID NO: 16461 - DNA, 20 bp, Artificial Sequence
  Synthetic construct
atgccggagtttgctgcgag

SEQ ID NO: 16462 - DNA, 21 bp, Artificial Sequence
  Synthetic construct
aagggagaagccgaaaccggc

SEQ ID NO: 16463 - DNA, 21 bp, Artificial Sequence
  Synthetic construct
cagggagaagccgaaaccggc

SEQ ID NO: 16464 - DNA, 21 bp, Artificial Sequence
  Synthetic construct
tagggagaagccgaaaccggc

SEQ ID NO: 16465 - DNA, 21 bp, Artificial Sequence
  Synthetic construct
gcgggagaagccgaaaccggc

SEQ ID NO: 16466 - DNA, 21 bp, Artificial Sequence
  Synthetic construct
gggggagaagccgaaaccggc

SEQ ID NO: 16467 - DNA, 21 bp, Artificial Sequence
  Synthetic construct
gtgggagaagccgaaaccggc

SEQ ID NO: 16468 - DNA, 21 bp, Artificial Sequence
  Synthetic construct
gaaggagaagccgaaaccggc

SEQ ID NO: 16469 - DNA, 21 bp, Artificial Sequence
  Synthetic construct
gacggagaagccgaaaccggc

SEQ ID NO: 16470 - DNA, 21 bp, Artificial Sequence
  Synthetic construct
gatggagaagccgaaaccggc

SEQ ID NO: 16471 - DNA, 21 bp, Artificial Sequence
  Synthetic construct
gagagagaagccgaaaccggc

SEQ ID NO: 16472 - DNA, 21 bp, Artificial Sequence
  Synthetic construct
gagcgagaagccgaaaccggc

SEQ ID NO: 16473 - DNA, 21 bp, Artificial Sequence
  Synthetic construct
gagtgagaagccgaaaccggc

SEQ ID NO: 16474 - DNA, 21 bp, Artificial Sequence
  Synthetic construct
gaggaagaagccgaaaccggc

SEQ ID NO: 16475 - DNA, 21 bp, Artificial Sequence
  Synthetic construct
gaggcagaagccgaaaccggc

SEQ ID NO: 16476 - DNA, 21 bp, Artificial Sequence
  Synthetic construct
gaggtagaagccgaaaccggc

SEQ ID NO: 16477 - DNA, 21 bp, Artificial Sequence
  Synthetic construct
gagggcgaagccgaaaccggc

SEQ ID NO: 16478 - DNA, 21 bp, Artificial Sequence
  Synthetic construct
gagggggaagccgaaaccggc

SEQ ID NO: 16479 - DNA, 21 bp, Artificial Sequence
  Synthetic construct
gagggtgaagccgaaaccggc

SEQ ID NO: 16480 - DNA, 21 bp, Artificial Sequence
  Synthetic construct
gagggaaaagccgaaaccggc

SEQ ID NO: 16481 - DNA, 21 bp, Artificial Sequence
  Synthetic construct
gagggacaagccgaaaccggc

SEQ ID NO: 16482 - DNA, 21 bp, Artificial Sequence
  Synthetic construct
gagggataagccgaaaccggc

SEQ ID NO: 16483 - DNA, 21 bp, Artificial Sequence
  Synthetic construct
gagggagcagccgaaaccggc

SEQ ID NO: 16484 - DNA, 21 bp, Artificial Sequence
  Synthetic construct
gagggaggagccgaaaccggc

SEQ ID NO: 16485 - DNA, 21 bp, Artificial Sequence
  Synthetic construct
gagggagtagccgaaaccggc

SEQ ID NO: 16486 - DNA, 21 bp, Artificial Sequence
  Synthetic construct
gagggagacgccgaaaccggc

SEQ ID NO: 16487 - DNA, 21 bp, Artificial Sequence
  Synthetic construct
gagggagaggccgaaaccggc

SEQ ID NO: 16488 - DNA, 21 bp, Artificial Sequence
  Synthetic construct
gagggagatgccgaaaccggc

SEQ ID NO: 16489 - DNA, 21 bp, Artificial Sequence
  Synthetic construct
gagggagaaaccgaaaccggc

SEQ ID NO: 16490 - DNA, 21 bp, Artificial Sequence
  Synthetic construct
gagggagaacccgaaaccggc

SEQ ID NO: 16491 - DNA, 21 bp, Artificial Sequence
  Synthetic construct
gagggagaatccgaaaccggc

SEQ ID NO: 16492 - DNA, 21 bp, Artificial Sequence
  Synthetic construct
gagggagaagacgaaaccggc

SEQ ID NO: 16493 - DNA, 21 bp, Artificial Sequence
  Synthetic construct
gagggagaaggcgaaaccggc

SEQ ID NO: 16494 - DNA, 21 bp, Artificial Sequence
  Synthetic construct
gagggagaagtcgaaaccggc

SEQ ID NO: 16495 - DNA, 21 bp, Artificial Sequence
  Synthetic construct
gagggagaagcagaaaccggc

SEQ ID NO: 16496 - DNA, 21 bp, Artificial Sequence
  Synthetic construct
gagggagaagcggaaaccggc

SEQ ID NO: 16497 - DNA, 21 bp, Artificial Sequence
  Synthetic construct
gagggagaagctgaaaccggc

SEQ ID NO: 16498 - DNA, 21 bp, Artificial Sequence
  Synthetic construct
gagggagaagccaaaaccggc

SEQ ID NO: 16499 - DNA, 21 bp, Artificial Sequence
  Synthetic construct
gagggagaagcccaaaccggc

SEQ ID NO: 16500 - DNA, 21 bp, Artificial Sequence
  Synthetic construct
gagggagaagcctaaaccggc

SEQ ID NO: 16501 - DNA, 21 bp, Artificial Sequence
  Synthetic construct
gagggagaagccgcaaccggc

SEQ ID NO: 16502 - DNA, 21 bp, Artificial Sequence
  Synthetic construct
gagggagaagccggaaccggc

SEQ ID NO: 16503 - DNA, 21 bp, Artificial Sequence
  Synthetic construct
gagggagaagccgtaaccggc

SEQ ID NO: 16504 - DNA, 21 bp, Artificial Sequence
  Synthetic construct
gagggagaagccgacaccggc

SEQ ID NO: 16505 - DNA, 21 bp, Artificial Sequence
  Synthetic construct
gagggagaagccgagaccggc

SEQ ID NO: 16506 - DNA, 21 bp, Artificial Sequence
  Synthetic construct
gagggagaagccgataccggc

SEQ ID NO: 16507 - DNA, 21 bp, Artificial Sequence
  Synthetic construct
gagggagaagccgaacccggc

SEQ ID NO: 16508 - DNA, 21 bp, Artificial Sequence
  Synthetic construct
gagggagaagccgaagccggc

SEQ ID NO: 16509 - DNA, 21 bp, Artificial Sequence
  Synthetic construct
gagggagaagccgaatccggc

SEQ ID NO: 16510 - DNA, 21 bp, Artificial Sequence
  Synthetic construct
gagggagaagccgaaaacggc

SEQ ID NO: 16511 - DNA, 21 bp, Artificial Sequence
  Synthetic construct
gagggagaagccgaaagcggc

SEQ ID NO: 16512 - DNA, 21 bp, Artificial Sequence
  Synthetic construct
gagggagaagccgaaatcggc

SEQ ID NO: 16513 - DNA, 21 bp, Artificial Sequence
  Synthetic construct
gagggagaagccgaaacaggc

SEQ ID NO: 16514 - DNA, 21 bp, Artificial Sequence
  Synthetic construct
gagggagaagccgaaacgggc

SEQ ID NO: 16515 - DNA, 21 bp, Artificial Sequence
  Synthetic construct
gagggagaagccgaaactggc

SEQ ID NO: 16516 - DNA, 21 bp, Artificial Sequence
  Synthetic construct
gagggagaagccgaaaccagc

SEQ ID NO: 16517 - DNA, 21 bp, Artificial Sequence
  Synthetic construct
gagggagaagccgaaacccgc

SEQ ID NO: 16518 - DNA, 21 bp, Artificial Sequence
  Synthetic construct
gagggagaagccgaaacctgc

SEQ ID NO: 16519 - DNA, 21 bp, Artificial Sequence
  Synthetic construct
gagggagaagccgaaaccgac

SEQ ID NO: 16520 - DNA, 21 bp, Artificial Sequence
  Synthetic construct
gagggagaagccgaaaccgcc

SEQ ID NO: 16521 - DNA, 21 bp, Artificial Sequence
  Synthetic construct
gagggagaagccgaaaccgtc

SEQ ID NO: 16522 - DNA, 21 bp, Artificial Sequence
  Synthetic construct
gagggagaagccgaaaccgga

SEQ ID NO: 16523 - DNA, 21 bp, Artificial Sequence
  Synthetic construct
gagggagaagccgaaaccggg

SEQ ID NO: 16524 - DNA, 21 bp, Artificial Sequence
  Synthetic construct
gagggagaagccgaaaccggt

SEQ ID NO: 16525 - DNA, 21 bp, Artificial Sequence
  Synthetic construct
acacggtaaaagtgcgcgccg

SEQ ID NO: 16526 - DNA, 21 bp, Artificial Sequence
  Synthetic construct
gcacggtaaaagtgcgcgccg

SEQ ID NO: 16527 - DNA, 21 bp, Artificial Sequence
  Synthetic construct
tcacggtaaaagtgcgcgccg

SEQ ID NO: 16528 - DNA, 21 bp, Artificial Sequence
  Synthetic construct
caacggtaaaagtgcgcgccg

SEQ ID NO: 16529 - DNA, 21 bp, Artificial Sequence
  Synthetic construct
cgacggtaaaagtgcgcgccg

SEQ ID NO: 16530 - DNA, 21 bp, Artificial Sequence
  Synthetic construct
ctacggtaaaagtgcgcgccg

SEQ ID NO: 16531 - DNA, 21 bp, Artificial Sequence
  Synthetic construct
ccccggtaaaagtgcgcgccg

SEQ ID NO: 16532 - DNA, 21 bp, Artificial Sequence
  Synthetic construct
ccgcggtaaaagtgcgcgccg

SEQ ID NO: 16533 - DNA, 21 bp, Artificial Sequence
  Synthetic construct
cctcggtaaaagtgcgcgccg

SEQ ID NO: 16534 - DNA, 21 bp, Artificial Sequence
  Synthetic construct
ccaaggtaaaagtgcgcgccg

SEQ ID NO: 16535 - DNA, 21 bp, Artificial Sequence
  Synthetic construct
ccagggtaaaagtgcgcgccg

SEQ ID NO: 16536 - DNA, 21 bp, Artificial Sequence
  Synthetic construct
ccatggtaaaagtgcgcgccg

SEQ ID NO: 16537 - DNA, 21 bp, Artificial Sequence
  Synthetic construct
ccacagtaaaagtgcgcgccg

SEQ ID NO: 16538 - DNA, 21 bp, Artificial Sequence
  Synthetic construct
ccaccgtaaaagtgcgcgccg

SEQ ID NO: 16539 - DNA, 21 bp, Artificial Sequence
  Synthetic construct
ccactgtaaaagtgcgcgccg

SEQ ID NO: 16540 - DNA, 21 bp, Artificial Sequence
  Synthetic construct
ccacgataaaagtgcgcgccg

SEQ ID NO: 16541 - DNA, 21 bp, Artificial Sequence
  Synthetic construct
ccacgctaaaagtgcgcgccg

SEQ ID NO: 16542 - DNA, 21 bp, Artificial Sequence
  Synthetic construct
ccacgttaaaagtgcgcgccg

SEQ ID NO: 16543 - DNA, 21 bp, Artificial Sequence
  Synthetic construct
ccacggaaaaagtgcgcgccg

SEQ ID NO: 16544 - DNA, 21 bp, Artificial Sequence
  Synthetic construct
ccacggcaaaagtgcgcgccg

SEQ ID NO: 16545 - DNA, 21 bp, Artificial Sequence
  Synthetic construct
ccacgggaaaagtgcgcgccg

SEQ ID NO: 16546 - DNA, 21 bp, Artificial Sequence
  Synthetic construct
ccacggtcaaagtgcgcgccg

SEQ ID NO: 16547 - DNA, 21 bp, Artificial Sequence
  Synthetic construct
ccacggtgaaagtgcgcgccg

SEQ ID NO: 16548 - DNA, 21 bp, Artificial Sequence
  Synthetic construct
ccacggttaaagtgcgcgccg

SEQ ID NO: 16549 - DNA, 21 bp, Artificial Sequence
  Synthetic construct
ccacggtacaagtgcgcgccg

SEQ ID NO: 16550 - DNA, 21 bp, Artificial Sequence
  Synthetic construct
ccacggtagaagtgcgcgccg

SEQ ID NO: 16551 - DNA, 21 bp, Artificial Sequence
  Synthetic construct
ccacggtataagtgcgcgccg

SEQ ID NO: 16552 - DNA, 21 bp, Artificial Sequence
  Synthetic construct
ccacggtaacagtgcgcgccg

SEQ ID NO: 16553 - DNA, 21 bp, Artificial Sequence
  Synthetic construct
ccacggtaagagtgcgcgccg

SEQ ID NO: 16554 - DNA, 21 bp, Artificial Sequence
  Synthetic construct
ccacggtaatagtgcgcgccg

SEQ ID NO: 16555 - DNA, 21 bp, Artificial Sequence
  Synthetic construct
ccacggtaaacgtgcgcgccg

SEQ ID NO: 16556 - DNA, 21 bp, Artificial Sequence
  Synthetic construct
ccacggtaaaggtgcgcgccg

SEQ ID NO: 16557 - DNA, 21 bp, Artificial Sequence
  Synthetic construct
ccacggtaaatgtgcgcgccg

SEQ ID NO: 16558 - DNA, 21 bp, Artificial Sequence
  Synthetic construct
ccacggtaaaaatgcgcgccg

SEQ ID NO: 16559 - DNA, 21 bp, Artificial Sequence
  Synthetic construct
ccacggtaaaactgcgcgccg

SEQ ID NO: 16560 - DNA, 21 bp, Artificial Sequence
  Synthetic construct
ccacggtaaaattgcgcgccg

SEQ ID NO: 16561 - DNA, 21 bp, Artificial Sequence
  Synthetic construct
ccacggtaaaagagcgcgccg

SEQ ID NO: 16562 - DNA, 21 bp, Artificial Sequence
  Synthetic construct
ccacggtaaaagcgcgcgccg

SEQ ID NO: 16563 - DNA, 21 bp, Artificial Sequence
  Synthetic construct
ccacggtaaaagggcgcgccg

SEQ ID NO: 16564 - DNA, 21 bp, Artificial Sequence
  Synthetic construct
ccacggtaaaagtacgcgccg

SEQ ID NO: 16565 - DNA, 21 bp, Artificial Sequence
  Synthetic construct
ccacggtaaaagtccgcgccg

SEQ ID NO: 16566 - DNA, 21 bp, Artificial Sequence
  Synthetic construct
ccacggtaaaagttcgcgccg

SEQ ID NO: 16567 - DNA, 21 bp, Artificial Sequence
  Synthetic construct
ccacggtaaaagtgagcgccg

SEQ ID NO: 16568 - DNA, 21 bp, Artificial Sequence
  Synthetic construct
ccacggtaaaagtgggcgccg

SEQ ID NO: 16569 - DNA, 21 bp, Artificial Sequence
  Synthetic construct
ccacggtaaaagtgtgcgccg

SEQ ID NO: 16570 - DNA, 21 bp, Artificial Sequence
  Synthetic construct
ccacggtaaaagtgcacgccg

SEQ ID NO: 16571 - DNA, 21 bp, Artificial Sequence
  Synthetic construct
ccacggtaaaagtgcccgccg

SEQ ID NO: 16572 - DNA, 21 bp, Artificial Sequence
  Synthetic construct
ccacggtaaaagtgctcgccg

SEQ ID NO: 16573 - DNA, 21 bp, Artificial Sequence
  Synthetic construct
ccacggtaaaagtgcgagccg

SEQ ID NO: 16574 - DNA, 21 bp, Artificial Sequence
  Synthetic construct
ccacggtaaaagtgcgggccg

SEQ ID NO: 16575 - DNA, 21 bp, Artificial Sequence
  Synthetic construct
ccacggtaaaagtgcgtgccg

SEQ ID NO: 16576 - DNA, 21 bp, Artificial Sequence
  Synthetic construct
ccacggtaaaagtgcgcaccg

SEQ ID NO: 16577 - DNA, 21 bp, Artificial Sequence
  Synthetic construct
ccacggtaaaagtgcgccccg

SEQ ID NO: 16578 - DNA, 21 bp, Artificial Sequence
  Synthetic construct
ccacggtaaaagtgcgctccg

SEQ ID NO: 16579 - DNA, 21 bp, Artificial Sequence
  Synthetic construct
ccacggtaaaagtgcgcgacg

SEQ ID NO: 16580 - DNA, 21 bp, Artificial Sequence
  Synthetic construct
ccacggtaaaagtgcgcggcg

SEQ ID NO: 16581 - DNA, 21 bp, Artificial Sequence
  Synthetic construct
ccacggtaaaagtgcgcgtcg

SEQ ID NO: 16582 - DNA, 21 bp, Artificial Sequence
  Synthetic construct
ccacggtaaaagtgcgcgcag

SEQ ID NO: 16583 - DNA, 21 bp, Artificial Sequence
  Synthetic construct
ccacggtaaaagtgcgcgcgg

SEQ ID NO: 16584 - DNA, 21 bp, Artificial Sequence
  Synthetic construct
ccacggtaaaagtgcgcgctg

SEQ ID NO: 16585 - DNA, 21 bp, Artificial Sequence
  Synthetic construct
ccacggtaaaagtgcgcgcca

SEQ ID NO: 16586 - DNA, 21 bp, Artificial Sequence
  Synthetic construct
ccacggtaaaagtgcgcgccc

SEQ ID NO: 16587 - DNA, 21 bp, Artificial Sequence
  Synthetic construct
ccacggtaaaagtgcgcgcct

SEQ ID NO: 16588 - DNA, 21 bp, Artificial Sequence
  Synthetic construct
acggcgttagccactccgaag

SEQ ID NO: 16589 - DNA, 21 bp, Artificial Sequence
  Synthetic construct
gcggcgttagccactccgaag

SEQ ID NO: 16590 - DNA, 21 bp, Artificial Sequence
  Synthetic construct
tcggcgttagccactccgaag

SEQ ID NO: 16591 - DNA, 21 bp, Artificial Sequence
  Synthetic construct
caggcgttagccactccgaag

SEQ ID NO: 16592 - DNA, 21 bp, Artificial Sequence
  Synthetic construct
cgggcgttagccactccgaag

SEQ ID NO: 16593 - DNA, 21 bp, Artificial Sequence
  Synthetic construct
ctggcgttagccactccgaag

SEQ ID NO: 16594 - DNA, 21 bp, Artificial Sequence
  Synthetic construct
ccagcgttagccactccgaag

SEQ ID NO: 16595 - DNA, 21 bp, Artificial Sequence
  Synthetic construct
cccgcgttagccactccgaag

SEQ ID NO: 16596 - DNA, 21 bp, Artificial Sequence
  Synthetic construct
cctgcgttagccactccgaag

SEQ ID NO: 16597 - DNA, 21 bp, Artificial Sequence
  Synthetic construct
ccgacgttagccactccgaag

SEQ ID NO: 16598 - DNA, 21 bp, Artificial Sequence
  Synthetic construct
ccgccgttagccactccgaag

SEQ ID NO: 16599 - DNA, 21 bp, Artificial Sequence
  Synthetic construct
ccgtcgttagccactccgaag

SEQ ID NO: 16600 - DNA, 21 bp, Artificial Sequence
  Synthetic construct
ccggagttagccactccgaag

SEQ ID NO: 16601 - DNA, 21 bp, Artificial Sequence
  Synthetic construct
ccggggttagccactccgaag

SEQ ID NO: 16602 - DNA, 21 bp, Artificial Sequence
  Synthetic construct
ccggtgttagccactccgaag

SEQ ID NO: 16603 - DNA, 21 bp, Artificial Sequence
  Synthetic construct
ccggcattagccactccgaag

SEQ ID NO: 16604 - DNA, 21 bp, Artificial Sequence
  Synthetic construct
ccggccttagccactccgaag

SEQ ID NO: 16605 - DNA, 21 bp, Artificial Sequence
  Synthetic construct
ccggctttagccactccgaag

SEQ ID NO: 16606 - DNA, 21 bp, Artificial Sequence
  Synthetic construct
ccggcgatagccactccgaag

SEQ ID NO: 16607 - DNA, 21 bp, Artificial Sequence
  Synthetic construct
ccggcgctagccactccgaag

SEQ ID NO: 16608 - DNA, 21 bp, Artificial Sequence
  Synthetic construct
ccggcggtagccactccgaag

SEQ ID NO: 16609 - DNA, 21 bp, Artificial Sequence
  Synthetic construct
ccggcgtaagccactccgaag

SEQ ID NO: 16610 - DNA, 21 bp, Artificial Sequence
  Synthetic construct
ccggcgtcagccactccgaag

SEQ ID NO: 16611 - DNA, 21 bp, Artificial Sequence
  Synthetic construct
ccggcgtgagccactccgaag

SEQ ID NO: 16612 - DNA, 21 bp, Artificial Sequence
  Synthetic construct
ccggcgttcgccactccgaag

SEQ ID NO: 16613 - DNA, 21 bp, Artificial Sequence
  Synthetic construct
ccggcgttggccactccgaag

SEQ ID NO: 16614 - DNA, 21 bp, Artificial Sequence
  Synthetic construct
ccggcgtttgccactccgaag

SEQ ID NO: 16615 - DNA, 21 bp, Artificial Sequence
  Synthetic construct
ccggcgttaaccactccgaag

SEQ ID NO: 16616 - DNA, 21 bp, Artificial Sequence
  Synthetic construct
ccggcgttacccactccgaag

SEQ ID NO: 16617 - DNA, 21 bp, Artificial Sequence
  Synthetic construct
ccggcgttatccactccgaag

SEQ ID NO: 16618 - DNA, 21 bp, Artificial Sequence
  Synthetic construct
ccggcgttagacactccgaag

SEQ ID NO: 16619 - DNA, 21 bp, Artificial Sequence
  Synthetic construct
ccggcgttaggcactccgaag

SEQ ID NO: 16620 - DNA, 21 bp, Artificial Sequence
  Synthetic construct
ccggcgttagtcactccgaag

SEQ ID NO: 16621 - DNA, 21 bp, Artificial Sequence
  Synthetic construct
ccggcgttagcaactccgaag

SEQ ID NO: 16622 - DNA, 21 bp, Artificial Sequence
  Synthetic construct
ccggcgttagcgactccgaag

SEQ ID NO: 16623 - DNA, 21 bp, Artificial Sequence
  Synthetic construct
ccggcgttagctactccgaag

SEQ ID NO: 16624 - DNA, 21 bp, Artificial Sequence
  Synthetic construct
ccggcgttagcccctccgaag

SEQ ID NO: 16625 - DNA, 21 bp, Artificial Sequence
  Synthetic construct
ccggcgttagccgctccgaag

SEQ ID NO: 16626 - DNA, 21 bp, Artificial Sequence
  Synthetic construct
ccggcgttagcctctccgaag

SEQ ID NO: 16627 - DNA, 21 bp, Artificial Sequence
  Synthetic construct
ccggcgttagccaatccgaag

SEQ ID NO: 16628 - DNA, 21 bp, Artificial Sequence
  Synthetic construct
ccggcgttagccagtccgaag

SEQ ID NO: 16629 - DNA, 21 bp, Artificial Sequence
  Synthetic construct
ccggcgttagccattccgaag

SEQ ID NO: 16630 - DNA, 21 bp, Artificial Sequence
  Synthetic construct
ccggcgttagccacaccgaag

SEQ ID NO: 16631 - DNA, 21 bp, Artificial Sequence
  Synthetic construct
ccggcgttagccaccccgaag

SEQ ID NO: 16632 - DNA, 21 bp, Artificial Sequence
  Synthetic construct
ccggcgttagccacgccgaag

SEQ ID NO: 16633 - DNA, 21 bp, Artificial Sequence
  Synthetic construct
ccggcgttagccactacgaag

SEQ ID NO: 16634 - DNA, 21 bp, Artificial Sequence
  Synthetic construct
ccggcgttagccactgcgaag

SEQ ID NO: 16635 - DNA, 21 bp, Artificial Sequence
  Synthetic construct
ccggcgttagccacttcgaag

SEQ ID NO: 16636 - DNA, 21 bp, Artificial Sequence
  Synthetic construct
ccggcgttagccactcagaag

SEQ ID NO: 16637 - DNA, 21 bp, Artificial Sequence
  Synthetic construct
ccggcgttagccactcggaag

SEQ ID NO: 16638 - DNA, 21 bp, Artificial Sequence
  Synthetic construct
ccggcgttagccactctgaag

SEQ ID NO: 16639 - DNA, 21 bp, Artificial Sequence
  Synthetic construct
ccggcgttagccactccaaag

SEQ ID NO: 16640 - DNA, 21 bp, Artificial Sequence
  Synthetic construct
ccggcgttagccactcccaag

SEQ ID NO: 16641 - DNA, 21 bp, Artificial Sequence
  Synthetic construct
ccggcgttagccactcctaag

SEQ ID NO: 16642 - DNA, 21 bp, Artificial Sequence
  Synthetic construct
ccggcgttagccactccgcag

SEQ ID NO: 16643 - DNA, 21 bp, Artificial Sequence
  Synthetic construct
ccggcgttagccactccggag

SEQ ID NO: 16644 - DNA, 21 bp, Artificial Sequence
  Synthetic construct
ccggcgttagccactccgtag

SEQ ID NO: 16645 - DNA, 21 bp, Artificial Sequence
  Synthetic construct
ccggcgttagccactccgacg

SEQ ID NO: 16646 - DNA, 21 bp, Artificial Sequence
  Synthetic construct
ccggcgttagccactccgagg

SEQ ID NO: 16647 - DNA, 21 bp, Artificial Sequence
  Synthetic construct
ccggcgttagccactccgatg

SEQ ID NO: 16648 - DNA, 21 bp, Artificial Sequence
  Synthetic construct
ccggcgttagccactccgaaa

SEQ ID NO: 16649 - DNA, 21 bp, Artificial Sequence
  Synthetic construct
ccggcgttagccactccgaac

SEQ ID NO: 16650 - DNA, 21 bp, Artificial Sequence
  Synthetic construct
ccggcgttagccactccgaat

SEQ ID NO: 16651 - DNA, 22 bp, Artificial Sequence
  Synthetic construct
cgcgaggtccgtcccaccgaag

SEQ ID NO: 16652 - DNA, 22 bp, Artificial Sequence
  Synthetic construct
ggcgaggtccgtcccaccgaag

SEQ ID NO: 16653 - DNA, 22 bp, Artificial Sequence
  Synthetic construct
tgcgaggtccgtcccaccgaag

SEQ ID NO: 16654 - DNA, 22 bp, Artificial Sequence
  Synthetic construct
aacgaggtccgtcccaccgaag

SEQ ID NO: 16655 - DNA, 22 bp, Artificial Sequence
  Synthetic construct
accgaggtccgtcccaccgaag

SEQ ID NO: 16656 - DNA, 22 bp, Artificial Sequence
  Synthetic construct
atcgaggtccgtcccaccgaag

SEQ ID NO: 16657 - DNA, 22 bp, Artificial Sequence
  Synthetic construct
agagaggtccgtcccaccgaag

SEQ ID NO: 16658 - DNA, 22 bp, Artificial Sequence
  Synthetic construct
agggaggtccgtcccaccgaag

SEQ ID NO: 16659 - DNA, 22 bp, Artificial Sequence
  Synthetic construct
agtgaggtccgtcccaccgaag

SEQ ID NO: 16660 - DNA, 22 bp, Artificial Sequence
  Synthetic construct
agcaaggtccgtcccaccgaag

SEQ ID NO: 16661 - DNA, 22 bp, Artificial Sequence
  Synthetic construct
agccaggtccgtcccaccgaag

SEQ ID NO: 16662 - DNA, 22 bp, Artificial Sequence
  Synthetic construct
agctaggtccgtcccaccgaag

SEQ ID NO: 16663 - DNA, 22 bp, Artificial Sequence
  Synthetic construct
agcgcggtccgtcccaccgaag

SEQ ID NO: 16664 - DNA, 22 bp, Artificial Sequence
  Synthetic construct
agcggggtccgtcccaccgaag

SEQ ID NO: 16665 - DNA, 22 bp, Artificial Sequence
  Synthetic construct
agcgtggtccgtcccaccgaag

SEQ ID NO: 16666 - DNA, 22 bp, Artificial Sequence
  Synthetic construct
agcgaagtccgtcccaccgaag

SEQ ID NO: 16667 - DNA, 22 bp, Artificial Sequence
  Synthetic construct
agcgacgtccgtcccaccgaag

SEQ ID NO: 16668 - DNA, 22 bp, Artificial Sequence
  Synthetic construct
agcgatgtccgtcccaccgaag

SEQ ID NO: 16669 - DNA, 22 bp, Artificial Sequence
  Synthetic construct
agcgagatccgtcccaccgaag

SEQ ID NO: 16670 - DNA, 22 bp, Artificial Sequence
  Synthetic construct
agcgagctccgtcccaccgaag

SEQ ID NO: 16671 - DNA, 22 bp, Artificial Sequence
  Synthetic construct
agcgagttccgtcccaccgaag

SEQ ID NO: 16672 - DNA, 22 bp, Artificial Sequence
  Synthetic construct
agcgaggaccgtcccaccgaag

SEQ ID NO: 16673 - DNA, 22 bp, Artificial Sequence
  Synthetic construct
agcgaggcccgtcccaccgaag

SEQ ID NO: 16674 - DNA, 22 bp, Artificial Sequence
  Synthetic construct
agcgagggccgtcccaccgaag

SEQ ID NO: 16675 - DNA, 22 bp, Artificial Sequence
  Synthetic construct
agcgaggtacgtcccaccgaag

SEQ ID NO: 16676 - DNA, 22 bp, Artificial Sequence
  Synthetic construct
agcgaggtgcgtcccaccgaag

SEQ ID NO: 16677 - DNA, 22 bp, Artificial Sequence
  Synthetic construct
agcgaggttcgtcccaccgaag

SEQ ID NO: 16678 - DNA, 22 bp, Artificial Sequence
  Synthetic construct
agcgaggtcagtcccaccgaag

SEQ ID NO: 16679 - DNA, 22 bp, Artificial Sequence
  Synthetic construct
agcgaggtcggtcccaccgaag

SEQ ID NO: 16680 - DNA, 22 bp, Artificial Sequence
  Synthetic construct
agcgaggtctgtcccaccgaag

SEQ ID NO: 16681 - DNA, 22 bp, Artificial Sequence
  Synthetic construct
agcgaggtccatcccaccgaag

SEQ ID NO: 16682 - DNA, 22 bp, Artificial Sequence
  Synthetic construct
agcgaggtccctcccaccgaag

SEQ ID NO: 16683 - DNA, 22 bp, Artificial Sequence
  Synthetic construct
agcgaggtccttcccaccgaag

SEQ ID NO: 16684 - DNA, 22 bp, Artificial Sequence
  Synthetic construct
agcgaggtccgacccaccgaag

SEQ ID NO: 16685 - DNA, 22 bp, Artificial Sequence
  Synthetic construct
agcgaggtccgccccaccgaag

SEQ ID NO: 16686 - DNA, 22 bp, Artificial Sequence
  Synthetic construct
agcgaggtccggcccaccgaag

SEQ ID NO: 16687 - DNA, 22 bp, Artificial Sequence
  Synthetic construct
agcgaggtccgtaccaccgaag

SEQ ID NO: 16688 - DNA, 22 bp, Artificial Sequence
  Synthetic construct
agcgaggtccgtgccaccgaag

SEQ ID NO: 16689 - DNA, 22 bp, Artificial Sequence
  Synthetic construct
agcgaggtccgttccaccgaag

SEQ ID NO: 16690 - DNA, 22 bp, Artificial Sequence
  Synthetic construct
agcgaggtccgtcacaccgaag

SEQ ID NO: 16691 - DNA, 22 bp, Artificial Sequence
  Synthetic construct
agcgaggtccgtcgcaccgaag

SEQ ID NO: 16692 - DNA, 22 bp, Artificial Sequence
  Synthetic construct
agcgaggtccgtctcaccgaag

SEQ ID NO: 16693 - DNA, 22 bp, Artificial Sequence
  Synthetic construct
agcgaggtccgtccaaccgaag

SEQ ID NO: 16694 - DNA, 22 bp, Artificial Sequence
  Synthetic construct
agcgaggtccgtccgaccgaag

SEQ ID NO: 16695 - DNA, 22 bp, Artificial Sequence
  Synthetic construct
agcgaggtccgtcctaccgaag

SEQ ID NO: 16696 - DNA, 22 bp, Artificial Sequence
  Synthetic construct
agcgaggtccgtccccccgaag

SEQ ID NO: 16697 - DNA, 22 bp, Artificial Sequence
  Synthetic construct
agcgaggtccgtcccgccgaag

SEQ ID NO: 16698 - DNA, 22 bp, Artificial Sequence
  Synthetic construct
agcgaggtccgtccctccgaag

SEQ ID NO: 16699 - DNA, 22 bp, Artificial Sequence
  Synthetic construct
agcgaggtccgtcccaacgaag

SEQ ID NO: 16700 - DNA, 22 bp, Artificial Sequence
  Synthetic construct
agcgaggtccgtcccagcgaag

SEQ ID NO: 16701 - DNA, 22 bp, Artificial Sequence
  Synthetic construct
agcgaggtccgtcccatcgaag

SEQ ID NO: 16702 - DNA, 22 bp, Artificial Sequence
  Synthetic construct
agcgaggtccgtcccacagaag

SEQ ID NO: 16703 - DNA, 22 bp, Artificial Sequence
  Synthetic construct
agcgaggtccgtcccacggaag

SEQ ID NO: 16704 - DNA, 22 bp, Artificial Sequence
  Synthetic construct
agcgaggtccgtcccactgaag

SEQ ID NO: 16705 - DNA, 22 bp, Artificial Sequence
  Synthetic construct
agcgaggtccgtcccaccaaag

SEQ ID NO: 16706 - DNA, 22 bp, Artificial Sequence
  Synthetic construct
agcgaggtccgtcccacccaag

SEQ ID NO: 16707 - DNA, 22 bp, Artificial Sequence
  Synthetic construct
agcgaggtccgtcccacctaag

SEQ ID NO: 16708 - DNA, 22 bp, Artificial Sequence
  Synthetic construct
agcgaggtccgtcccaccgcag

SEQ ID NO: 16709 - DNA, 22 bp, Artificial Sequence
  Synthetic construct
agcgaggtccgtcccaccggag

SEQ ID NO: 16710 - DNA, 22 bp, Artificial Sequence
  Synthetic construct
agcgaggtccgtcccaccgtag

SEQ ID NO: 16711 - DNA, 22 bp, Artificial Sequence
  Synthetic construct
agcgaggtccgtcccaccgacg

SEQ ID NO: 16712 - DNA, 22 bp, Artificial Sequence
  Synthetic construct
agcgaggtccgtcccaccgagg

SEQ ID NO: 16713 - DNA, 22 bp, Artificial Sequence
  Synthetic construct
agcgaggtccgtcccaccgatg

SEQ ID NO: 16714 - DNA, 22 bp, Artificial Sequence
  Synthetic construct
agcgaggtccgtcccaccgaaa

SEQ ID NO: 16715 - DNA, 22 bp, Artificial Sequence
  Synthetic construct
agcgaggtccgtcccaccgaac

SEQ ID NO: 16716 - DNA, 22 bp, Artificial Sequence
  Synthetic construct
agcgaggtccgtcccaccgaat

SEQ ID NO: 16717 - DNA, 20 bp, Artificial Sequence
  Synthetic construct
aggattgtacccctcgatgc

SEQ ID NO: 16718 - DNA, 20 bp, Artificial Sequence
  Synthetic construct
gggattgtacccctcgatgc

SEQ ID NO: 16719 - DNA, 20 bp, Artificial Sequence
  Synthetic construct
tggattgtacccctcgatgc

SEQ ID NO: 16720 - DNA, 20 bp, Artificial Sequence
  Synthetic construct
cagattgtacccctcgatgc

SEQ ID NO: 16721 - DNA, 20 bp, Artificial Sequence
  Synthetic construct
ccgattgtacccctcgatgc

SEQ ID NO: 16722 - DNA, 20 bp, Artificial Sequence
  Synthetic construct
ctgattgtacccctcgatgc

SEQ ID NO: 16723 - DNA, 20 bp, Artificial Sequence
  Synthetic construct
cgaattgtacccctcgatgc

SEQ ID NO: 16724 - DNA, 20 bp, Artificial Sequence
  Synthetic construct
cgcattgtacccctcgatgc

SEQ ID NO: 16725 - DNA, 20 bp, Artificial Sequence
  Synthetic construct
cgtattgtacccctcgatgc

SEQ ID NO: 16726 - DNA, 20 bp, Artificial Sequence
  Synthetic construct
cggcttgtacccctcgatgc

SEQ ID NO: 16727 - DNA, 20 bp, Artificial Sequence
  Synthetic construct
cgggttgtacccctcgatgc

SEQ ID NO: 16728 - DNA, 20 bp, Artificial Sequence
  Synthetic construct
cggtttgtacccctcgatgc

SEQ ID NO: 16729 - DNA, 20 bp, Artificial Sequence
  Synthetic construct
cggaatgtacccctcgatgc

SEQ ID NO: 16730 - DNA, 20 bp, Artificial Sequence
  Synthetic construct
cggactgtacccctcgatgc

SEQ ID NO: 16731 - DNA, 20 bp, Artificial Sequence
  Synthetic construct
cggagtgtacccctcgatgc

SEQ ID NO: 16732 - DNA, 20 bp, Artificial Sequence
  Synthetic construct
cggatagtacccctcgatgc

SEQ ID NO: 16733 - DNA, 20 bp, Artificial Sequence
  Synthetic construct
cggatcgtacccctcgatgc

SEQ ID NO: 16734 - DNA, 20 bp, Artificial Sequence
  Synthetic construct
cggatggtacccctcgatgc

SEQ ID NO: 16735 - DNA, 20 bp, Artificial Sequence
  Synthetic construct
cggattatacccctcgatgc

SEQ ID NO: 16736 - DNA, 20 bp, Artificial Sequence
  Synthetic construct
cggattctacccctcgatgc

SEQ ID NO: 16737 - DNA, 20 bp, Artificial Sequence
  Synthetic construct
cggattttacccctcgatgc

SEQ ID NO: 16738 - DNA, 20 bp, Artificial Sequence
  Synthetic construct
cggattgaacccctcgatgc

SEQ ID NO: 16739 - DNA, 20 bp, Artificial Sequence
  Synthetic construct
cggattgcacccctcgatgc

SEQ ID NO: 16740 - DNA, 20 bp, Artificial Sequence
  Synthetic construct
cggattggacccctcgatgc

SEQ ID NO: 16741 - DNA, 20 bp, Artificial Sequence
  Synthetic construct
cggattgtccccctcgatgc

SEQ ID NO: 16742 - DNA, 20 bp, Artificial Sequence
  Synthetic construct
cggattgtgcccctcgatgc

SEQ ID NO: 16743 - DNA, 20 bp, Artificial Sequence
  Synthetic construct
cggattgttcccctcgatgc

SEQ ID NO: 16744 - DNA, 20 bp, Artificial Sequence
  Synthetic construct
cggattgtaaccctcgatgc

SEQ ID NO: 16745 - DNA, 20 bp, Artificial Sequence
  Synthetic construct
cggattgtagccctcgatgc

SEQ ID NO: 16746 - DNA, 20 bp, Artificial Sequence
  Synthetic construct
cggattgtatccctcgatgc

SEQ ID NO: 16747 - DNA, 20 bp, Artificial Sequence
  Synthetic construct
cggattgtacacctcgatgc

SEQ ID NO: 16748 - DNA, 20 bp, Artificial Sequence
  Synthetic construct
cggattgtacgcctcgatgc

SEQ ID NO: 16749 - DNA, 20 bp, Artificial Sequence
  Synthetic construct
cggattgtactcctcgatgc

SEQ ID NO: 16750 - DNA, 20 bp, Artificial Sequence
  Synthetic construct
cggattgtaccactcgatgc

SEQ ID NO: 16751 - DNA, 20 bp, Artificial Sequence
  Synthetic construct
cggattgtaccgctcgatgc

SEQ ID NO: 16752 - DNA, 20 bp, Artificial Sequence
  Synthetic construct
cggattgtacctctcgatgc

SEQ ID NO: 16753 - DNA, 20 bp, Artificial Sequence
  Synthetic construct
cggattgtacccatcgatgc

SEQ ID NO: 16754 - DNA, 20 bp, Artificial Sequence
  Synthetic construct
cggattgtacccgtcgatgc

SEQ ID NO: 16755 - DNA, 20 bp, Artificial Sequence
  Synthetic construct
cggattgtacccttcgatgc

SEQ ID NO: 16756 - DNA, 20 bp, Artificial Sequence
  Synthetic construct
cggattgtaccccacgatgc

SEQ ID NO: 16757 - DNA, 20 bp, Artificial Sequence
  Synthetic construct
cggattgtaccccccgatgc

SEQ ID NO: 16758 - DNA, 20 bp, Artificial Sequence
  Synthetic construct
cggattgtaccccgcgatgc

SEQ ID NO: 16759 - DNA, 20 bp, Artificial Sequence
  Synthetic construct
cggattgtacccctagatgc

SEQ ID NO: 16760 - DNA, 20 bp, Artificial Sequence
  Synthetic construct
cggattgtacccctggatgc

SEQ ID NO: 16761 - DNA, 20 bp, Artificial Sequence
  Synthetic construct
cggattgtaccccttgatgc

SEQ ID NO: 16762 - DNA, 20 bp, Artificial Sequence
  Synthetic construct
cggattgtacccctcaatgc

SEQ ID NO: 16763 - DNA, 20 bp, Artificial Sequence
  Synthetic construct
cggattgtacccctccatgc

SEQ ID NO: 16764 - DNA, 20 bp, Artificial Sequence
  Synthetic construct
cggattgtacccctctatgc

SEQ ID NO: 16765 - DNA, 20 bp, Artificial Sequence
  Synthetic construct
cggattgtacccctcgctgc

SEQ ID NO: 16766 - DNA, 20 bp, Artificial Sequence
  Synthetic construct
cggattgtacccctcggtgc

SEQ ID NO: 16767 - DNA, 20 bp, Artificial Sequence
  Synthetic construct
cggattgtacccctcgttgc

SEQ ID NO: 16768 - DNA, 20 bp, Artificial Sequence
  Synthetic construct
cggattgtacccctcgaagc

SEQ ID NO: 16769 - DNA, 20 bp, Artificial Sequence
  Synthetic construct
cggattgtacccctcgacgc

SEQ ID NO: 16770 - DNA, 20 bp, Artificial Sequence
  Synthetic construct
cggattgtacccctcgaggc

SEQ ID NO: 16771 - DNA, 20 bp, Artificial Sequence
  Synthetic construct
cggattgtacccctcgatac

SEQ ID NO: 16772 - DNA, 20 bp, Artificial Sequence
  Synthetic construct
cggattgtacccctcgatcc

SEQ ID NO: 16773 - DNA, 20 bp, Artificial Sequence
  Synthetic construct
cggattgtacccctcgattc

SEQ ID NO: 16774 - DNA, 20 bp, Artificial Sequence
  Synthetic construct
cggattgtacccctcgatga

SEQ ID NO: 16775 - DNA, 20 bp, Artificial Sequence
  Synthetic construct
cggattgtacccctcgatgg

SEQ ID NO: 16776 - DNA, 20 bp, Artificial Sequence
  Synthetic construct
cggattgtacccctcgatgt

SEQ ID NO: 16777 - DNA, 23 bp, Artificial Sequence
  Synthetic construct
atcggtgatttcacctccagtat

SEQ ID NO: 16778 - DNA, 23 bp, Artificial Sequence
  Synthetic construct
ctcggtgatttcacctccagtat

SEQ ID NO: 16779 - DNA, 23 bp, Artificial Sequence
  Synthetic construct
ttcggtgatttcacctccagtat

SEQ ID NO: 16780 - DNA, 23 bp, Artificial Sequence
  Synthetic construct
gacggtgatttcacctccagtat

SEQ ID NO: 16781 - DNA, 23 bp, Artificial Sequence
  Synthetic construct
gccggtgatttcacctccagtat

SEQ ID NO: 16782 - DNA, 23 bp, Artificial Sequence
  Synthetic construct
ggcggtgatttcacctccagtat

SEQ ID NO: 16783 - DNA, 23 bp, Artificial Sequence
  Synthetic construct
gtaggtgatttcacctccagtat

SEQ ID NO: 16784 - DNA, 23 bp, Artificial Sequence
  Synthetic construct
gtgggtgatttcacctccagtat

SEQ ID NO: 16785 - DNA, 23 bp, Artificial Sequence
  Synthetic construct
gttggtgatttcacctccagtat

SEQ ID NO: 16786 - DNA, 23 bp, Artificial Sequence
  Synthetic construct
gtcagtgatttcacctccagtat

SEQ ID NO: 16787 - DNA, 23 bp, Artificial Sequence
  Synthetic construct
gtccgtgatttcacctccagtat

SEQ ID NO: 16788 - DNA, 23 bp, Artificial Sequence
  Synthetic construct
gtctgtgatttcacctccagtat

SEQ ID NO: 16789 - DNA, 23 bp, Artificial Sequence
  Synthetic construct
gtcgatgatttcacctccagtat

SEQ ID NO: 16790 - DNA, 23 bp, Artificial Sequence
  Synthetic construct
gtcgctgatttcacctccagtat

SEQ ID NO: 16791 - DNA, 23 bp, Artificial Sequence
  Synthetic construct
gtcgttgatttcacctccagtat

SEQ ID NO: 16792 - DNA, 23 bp, Artificial Sequence
  Synthetic construct
gtcggagatttcacctccagtat

SEQ ID NO: 16793 - DNA, 23 bp, Artificial Sequence
  Synthetic construct
gtcggcgatttcacctccagtat

SEQ ID NO: 16794 - DNA, 23 bp, Artificial Sequence
  Synthetic construct
gtcggggatttcacctccagtat

SEQ ID NO: 16795 - DNA, 23 bp, Artificial Sequence
  Synthetic construct
gtcggtaatttcacctccagtat

SEQ ID NO: 16796 - DNA, 23 bp, Artificial Sequence
  Synthetic construct
gtcggtcatttcacctccagtat

SEQ ID NO: 16797 - DNA, 23 bp, Artificial Sequence
  Synthetic construct
gtcggttatttcacctccagtat

SEQ ID NO: 16798 - DNA, 23 bp, Artificial Sequence
  Synthetic construct
gtcggtgctttcacctccagtat

SEQ ID NO: 16799 - DNA, 23 bp, Artificial Sequence
  Synthetic construct
gtcggtggtttcacctccagtat

SEQ ID NO: 16800 - DNA, 23 bp, Artificial Sequence
  Synthetic construct
gtcggtgttttcacctccagtat

SEQ ID NO: 16801 - DNA, 23 bp, Artificial Sequence
  Synthetic construct
gtcggtgaattcacctccagtat

SEQ ID NO: 16802 - DNA, 23 bp, Artificial Sequence
  Synthetic construct
gtcggtgacttcacctccagtat

SEQ ID NO: 16803 - DNA, 23 bp, Artificial Sequence
  Synthetic construct
gtcggtgagttcacctccagtat

SEQ ID NO: 16804 - DNA, 23 bp, Artificial Sequence
  Synthetic construct
gtcggtgatatcacctccagtat

SEQ ID NO: 16805 - DNA, 23 bp, Artificial Sequence
  Synthetic construct
gtcggtgatctcacctccagtat

SEQ ID NO: 16806 - DNA, 23 bp, Artificial Sequence
  Synthetic construct
gtcggtgatgtcacctccagtat

SEQ ID NO: 16807 - DNA, 23 bp, Artificial Sequence
  Synthetic construct
gtcggtgattacacctccagtat

SEQ ID NO: 16808 - DNA, 23 bp, Artificial Sequence
  Synthetic construct
gtcggtgattccacctccagtat

SEQ ID NO: 16809 - DNA, 23 bp, Artificial Sequence
  Synthetic construct
gtcggtgattgcacctccagtat

SEQ ID NO: 16810 - DNA, 23 bp, Artificial Sequence
  Synthetic construct
gtcggtgatttaacctccagtat

SEQ ID NO: 16811 - DNA, 23 bp, Artificial Sequence
  Synthetic construct
gtcggtgatttgacctccagtat

SEQ ID NO: 16812 - DNA, 23 bp, Artificial Sequence
  Synthetic construct
gtcggtgattttacctccagtat

SEQ ID NO: 16813 - DNA, 23 bp, Artificial Sequence
  Synthetic construct
gtcggtgatttcccctccagtat

SEQ ID NO: 16814 - DNA, 23 bp, Artificial Sequence
  Synthetic construct
gtcggtgatttcgcctccagtat

SEQ ID NO: 16815 - DNA, 23 bp, Artificial Sequence
  Synthetic construct
gtcggtgatttctcctccagtat

SEQ ID NO: 16816 - DNA, 23 bp, Artificial Sequence
  Synthetic construct
gtcggtgatttcaactccagtat

SEQ ID NO: 16817 - DNA, 23 bp, Artificial Sequence
  Synthetic construct
gtcggtgatttcagctccagtat

SEQ ID NO: 16818 - DNA, 23 bp, Artificial Sequence
  Synthetic construct
gtcggtgatttcatctccagtat

SEQ ID NO: 16819 - DNA, 23 bp, Artificial Sequence
  Synthetic construct
gtcggtgatttcacatccagtat

SEQ ID NO: 16820 - DNA, 23 bp, Artificial Sequence
  Synthetic construct
gtcggtgatttcacgtccagtat

SEQ ID NO: 16821 - DNA, 23 bp, Artificial Sequence
  Synthetic construct
gtcggtgatttcacttccagtat

SEQ ID NO: 16822 - DNA, 23 bp, Artificial Sequence
  Synthetic construct
gtcggtgatttcaccaccagtat

SEQ ID NO: 16823 - DNA, 23 bp, Artificial Sequence
  Synthetic construct
gtcggtgatttcacccccagtat

SEQ ID NO: 16824 - DNA, 23 bp, Artificial Sequence
  Synthetic construct
gtcggtgatttcaccgccagtat

SEQ ID NO: 16825 - DNA, 23 bp, Artificial Sequence
  Synthetic construct
gtcggtgatttcacctacagtat

SEQ ID NO: 16826 - DNA, 23 bp, Artificial Sequence
  Synthetic construct
gtcggtgatttcacctgcagtat

SEQ ID NO: 16827 - DNA, 23 bp, Artificial Sequence
  Synthetic construct
gtcggtgatttcaccttcagtat

SEQ ID NO: 16828 - DNA, 23 bp, Artificial Sequence
  Synthetic construct
gtcggtgatttcacctcaagtat

SEQ ID NO: 16829 - DNA, 23 bp, Artificial Sequence
  Synthetic construct
gtcggtgatttcacctcgagtat

SEQ ID NO: 16830 - DNA, 23 bp, Artificial Sequence
  Synthetic construct
gtcggtgatttcacctctagtat

SEQ ID NO: 16831 - DNA, 23 bp, Artificial Sequence
  Synthetic construct
gtcggtgatttcacctcccgtat

SEQ ID NO: 16832 - DNA, 23 bp, Artificial Sequence
  Synthetic construct
gtcggtgatttcacctccggtat

SEQ ID NO: 16833 - DNA, 23 bp, Artificial Sequence
  Synthetic construct
gtcggtgatttcacctcctgtat

SEQ ID NO: 16834 - DNA, 23 bp, Artificial Sequence
  Synthetic construct
gtcggtgatttcacctccaatat

SEQ ID NO: 16835 - DNA, 23 bp, Artificial Sequence
  Synthetic construct
gtcggtgatttcacctccactat

SEQ ID NO: 16836 - DNA, 23 bp, Artificial Sequence
  Synthetic construct
gtcggtgatttcacctccattat

SEQ ID NO: 16837 - DNA, 23 bp, Artificial Sequence
  Synthetic construct
gtcggtgatttcacctccagaat

SEQ ID NO: 16838 - DNA, 23 bp, Artificial Sequence
  Synthetic construct
gtcggtgatttcacctccagcat

SEQ ID NO: 16839 - DNA, 23 bp, Artificial Sequence
  Synthetic construct
gtcggtgatttcacctccaggat

SEQ ID NO: 16840 - DNA, 23 bp, Artificial Sequence
  Synthetic construct
gtcggtgatttcacctccagtct

SEQ ID NO: 16841 - DNA, 23 bp, Artificial Sequence
  Synthetic construct
gtcggtgatttcacctccagtgt

SEQ ID NO: 16842 - DNA, 23 bp, Artificial Sequence
  Synthetic construct
gtcggtgatttcacctccagttt

SEQ ID NO: 16843 - DNA, 23 bp, Artificial Sequence
  Synthetic construct
gtcggtgatttcacctccagtaa

SEQ ID NO: 16844 - DNA, 23 bp, Artificial Sequence
  Synthetic construct
gtcggtgatttcacctccagtac

SEQ ID NO: 16845 - DNA, 23 bp, Artificial Sequence
  Synthetic construct
gtcggtgatttcacctccagtag

SEQ ID NO: 16846 - DNA, 20 bp, Artificial Sequence
  Synthetic construct
acacgatgacccacttcgct

SEQ ID NO: 16847 - DNA, 20 bp, Artificial Sequence
  Synthetic construct
gcacgatgacccacttcgct

SEQ ID NO: 16848 - DNA, 20 bp, Artificial Sequence
  Synthetic construct
tcacgatgacccacttcgct

SEQ ID NO: 16849 - DNA, 20 bp, Artificial Sequence
  Synthetic construct
caacgatgacccacttcgct

SEQ ID NO: 16850 - DNA, 20 bp, Artificial Sequence
  Synthetic construct
cgacgatgacccacttcgct

SEQ ID NO: 16851 - DNA, 20 bp, Artificial Sequence
  Synthetic construct
ctacgatgacccacttcgct

SEQ ID NO: 16852 - DNA, 20 bp, Artificial Sequence
  Synthetic construct
ccccgatgacccacttcgct

SEQ ID NO: 16853 - DNA, 20 bp, Artificial Sequence
  Synthetic construct
ccgcgatgacccacttcgct

SEQ ID NO: 16854 - DNA, 20 bp, Artificial Sequence
  Synthetic construct
cctcgatgacccacttcgct

SEQ ID NO: 16855 - DNA, 20 bp, Artificial Sequence
  Synthetic construct
ccaagatgacccacttcgct

SEQ ID NO: 16856 - DNA, 20 bp, Artificial Sequence
  Synthetic construct
ccaggatgacccacttcgct

SEQ ID NO: 16857 - DNA, 20 bp, Artificial Sequence
  Synthetic construct
ccatgatgacccacttcgct

SEQ ID NO: 16858 - DNA, 20 bp, Artificial Sequence
  Synthetic construct
ccacaatgacccacttcgct

SEQ ID NO: 16859 - DNA, 20 bp, Artificial Sequence
  Synthetic construct
ccaccatgacccacttcgct

SEQ ID NO: 16860 - DNA, 20 bp, Artificial Sequence
  Synthetic construct
ccactatgacccacttcgct

SEQ ID NO: 16861 - DNA, 20 bp, Artificial Sequence
  Synthetic construct
ccacgctgacccacttcgct

SEQ ID NO: 16862 - DNA, 20 bp, Artificial Sequence
  Synthetic construct
ccacggtgacccacttcgct

SEQ ID NO: 16863 - DNA, 20 bp, Artificial Sequence
  Synthetic construct
ccacgttgacccacttcgct

SEQ ID NO: 16864 - DNA, 20 bp, Artificial Sequence
  Synthetic construct
ccacgaagacccacttcgct

SEQ ID NO: 16865 - DNA, 20 bp, Artificial Sequence
  Synthetic construct
ccacgacgacccacttcgct

SEQ ID NO: 16866 - DNA, 20 bp, Artificial Sequence
  Synthetic construct
ccacgaggacccacttcgct

SEQ ID NO: 16867 - DNA, 20 bp, Artificial Sequence
  Synthetic construct
ccacgataacccacttcgct

SEQ ID NO: 16868 - DNA, 20 bp, Artificial Sequence
  Synthetic construct
ccacgatcacccacttcgct

SEQ ID NO: 16869 - DNA, 20 bp, Artificial Sequence
  Synthetic construct
ccacgattacccacttcgct

SEQ ID NO: 16870 - DNA, 20 bp, Artificial Sequence
  Synthetic construct
ccacgatgccccacttcgct

SEQ ID NO: 16871 - DNA, 20 bp, Artificial Sequence
  Synthetic construct
ccacgatggcccacttcgct

SEQ ID NO: 16872 - DNA, 20 bp, Artificial Sequence
  Synthetic construct
ccacgatgtcccacttcgct

SEQ ID NO: 16873 - DNA, 20 bp, Artificial Sequence
  Synthetic construct
ccacgatgaaccacttcgct

SEQ ID NO: 16874 - DNA, 20 bp, Artificial Sequence
  Synthetic construct
ccacgatgagccacttcgct

SEQ ID NO: 16875 - DNA, 20 bp, Artificial Sequence
  Synthetic construct
ccacgatgatccacttcgct

SEQ ID NO: 16876 - DNA, 20 bp, Artificial Sequence
  Synthetic construct
ccacgatgacacacttcgct

SEQ ID NO: 16877 - DNA, 20 bp, Artificial Sequence
  Synthetic construct
ccacgatgacgcacttcgct

SEQ ID NO: 16878 - DNA, 20 bp, Artificial Sequence
  Synthetic construct
ccacgatgactcacttcgct

SEQ ID NO: 16879 - DNA, 20 bp, Artificial Sequence
  Synthetic construct
ccacgatgaccaacttcgct

SEQ ID NO: 16880 - DNA, 20 bp, Artificial Sequence
  Synthetic construct
ccacgatgaccgacttcgct

SEQ ID NO: 16881 - DNA, 20 bp, Artificial Sequence
  Synthetic construct
ccacgatgacctacttcgct

SEQ ID NO: 16882 - DNA, 20 bp, Artificial Sequence
  Synthetic construct
ccacgatgacccccttcgct

SEQ ID NO: 16883 - DNA, 20 bp, Artificial Sequence
  Synthetic construct
ccacgatgacccgcttcgct

SEQ ID NO: 16884 - DNA, 20 bp, Artificial Sequence
  Synthetic construct
ccacgatgaccctcttcgct

SEQ ID NO: 16885 - DNA, 20 bp, Artificial Sequence
  Synthetic construct
ccacgatgacccaattcgct

SEQ ID NO: 16886 - DNA, 20 bp, Artificial Sequence
  Synthetic construct
ccacgatgacccagttcgct

SEQ ID NO: 16887 - DNA, 20 bp, Artificial Sequence
  Synthetic construct
ccacgatgacccatttcgct

SEQ ID NO: 16888 - DNA, 20 bp, Artificial Sequence
  Synthetic construct
ccacgatgacccacatcgct

SEQ ID NO: 16889 - DNA, 20 bp, Artificial Sequence
  Synthetic construct
ccacgatgacccacctcgct

SEQ ID NO: 16890 - DNA, 20 bp, Artificial Sequence
  Synthetic construct
ccacgatgacccacgtcgct

SEQ ID NO: 16891 - DNA, 20 bp, Artificial Sequence
  Synthetic construct
ccacgatgacccactacgct

SEQ ID NO: 16892 - DNA, 20 bp, Artificial Sequence
  Synthetic construct
ccacgatgacccactccgct

SEQ ID NO: 16893 - DNA, 20 bp, Artificial Sequence
  Synthetic construct
ccacgatgacccactgcgct

SEQ ID NO: 16894 - DNA, 20 bp, Artificial Sequence
  Synthetic construct
ccacgatgacccacttagct

SEQ ID NO: 16895 - DNA, 20 bp, Artificial Sequence
  Synthetic construct
ccacgatgacccacttggct

SEQ ID NO: 16896 - DNA, 20 bp, Artificial Sequence
  Synthetic construct
ccacgatgacccactttgct

SEQ ID NO: 16897 - DNA, 20 bp, Artificial Sequence
  Synthetic construct
ccacgatgacccacttcact

SEQ ID NO: 16898 - DNA, 20 bp, Artificial Sequence
  Synthetic construct
ccacgatgacccacttccct

SEQ ID NO: 16899 - DNA, 20 bp, Artificial Sequence
  Synthetic construct
ccacgatgacccacttctct

SEQ ID NO: 16900 - DNA, 20 bp, Artificial Sequence
  Synthetic construct
ccacgatgacccacttcgat

SEQ ID NO: 16901 - DNA, 20 bp, Artificial Sequence
  Synthetic construct
ccacgatgacccacttcggt

SEQ ID NO: 16902 - DNA, 20 bp, Artificial Sequence
  Synthetic construct
ccacgatgacccacttcgtt

SEQ ID NO: 16903 - DNA, 20 bp, Artificial Sequence
  Synthetic construct
ccacgatgacccacttcgca

SEQ ID NO: 16904 - DNA, 20 bp, Artificial Sequence
  Synthetic construct
ccacgatgacccacttcgcc

SEQ ID NO: 16905 - DNA, 20 bp, Artificial Sequence
  Synthetic construct
ccacgatgacccacttcgcg

SEQ ID NO: 16906 - DNA, 23 bp, Artificial Sequence
  Synthetic construct
attacctacaggtaggagccagt

SEQ ID NO: 16907 - DNA, 23 bp, Artificial Sequence
  Synthetic construct
cttacctacaggtaggagccagt

SEQ ID NO: 16908 - DNA, 23 bp, Artificial Sequence
  Synthetic construct
tttacctacaggtaggagccagt

SEQ ID NO: 16909 - DNA, 23 bp, Artificial Sequence
  Synthetic construct
gatacctacaggtaggagccagt

SEQ ID NO: 16910 - DNA, 23 bp, Artificial Sequence
  Synthetic construct
gctacctacaggtaggagccagt

SEQ ID NO: 16911 - DNA, 23 bp, Artificial Sequence
  Synthetic construct
ggtacctacaggtaggagccagt

SEQ ID NO: 16912 - DNA, 23 bp, Artificial Sequence
  Synthetic construct
gtaacctacaggtaggagccagt

SEQ ID NO: 16913 - DNA, 23 bp, Artificial Sequence
  Synthetic construct
gtcacctacaggtaggagccagt

SEQ ID NO: 16914 - DNA, 23 bp, Artificial Sequence
  Synthetic construct
gtgacctacaggtaggagccagt

SEQ ID NO: 16915 - DNA, 23 bp, Artificial Sequence
  Synthetic construct
gttccctacaggtaggagccagt

SEQ ID NO: 16916 - DNA, 23 bp, Artificial Sequence
  Synthetic construct
gttgcctacaggtaggagccagt

SEQ ID NO: 16917 - DNA, 23 bp, Artificial Sequence
  Synthetic construct
gtttcctacaggtaggagccagt

SEQ ID NO: 16918 - DNA, 23 bp, Artificial Sequence
  Synthetic construct
gttaactacaggtaggagccagt

SEQ ID NO: 16919 - DNA, 23 bp, Artificial Sequence
  Synthetic construct
gttagctacaggtaggagccagt

SEQ ID NO: 16920 - DNA, 23 bp, Artificial Sequence
  Synthetic construct
gttatctacaggtaggagccagt

SEQ ID NO: 16921 - DNA, 23 bp, Artificial Sequence
  Synthetic construct
gttacatacaggtaggagccagt

SEQ ID NO: 16922 - DNA, 23 bp, Artificial Sequence
  Synthetic construct
gttacgtacaggtaggagccagt

SEQ ID NO: 16923 - DNA, 23 bp, Artificial Sequence
  Synthetic construct
gttacttacaggtaggagccagt

SEQ ID NO: 16924 - DNA, 23 bp, Artificial Sequence
  Synthetic construct
gttaccaacaggtaggagccagt

SEQ ID NO: 16925 - DNA, 23 bp, Artificial Sequence
  Synthetic construct
gttacccacaggtaggagccagt

SEQ ID NO: 16926 - DNA, 23 bp, Artificial Sequence
  Synthetic construct
gttaccgacaggtaggagccagt

SEQ ID NO: 16927 - DNA, 23 bp, Artificial Sequence
  Synthetic construct
gttacctccaggtaggagccagt

SEQ ID NO: 16928 - DNA, 23 bp, Artificial Sequence
  Synthetic construct
gttacctgcaggtaggagccagt

SEQ ID NO: 16929 - DNA, 23 bp, Artificial Sequence
  Synthetic construct
gttaccttcaggtaggagccagt

SEQ ID NO: 16930 - DNA, 23 bp, Artificial Sequence
  Synthetic construct
gttacctaaaggtaggagccagt

SEQ ID NO: 16931 - DNA, 23 bp, Artificial Sequence
  Synthetic construct
gttacctagaggtaggagccagt

SEQ ID NO: 16932 - DNA, 23 bp, Artificial Sequence
  Synthetic construct
gttacctataggtaggagccagt

SEQ ID NO: 16933 - DNA, 23 bp, Artificial Sequence
  Synthetic construct
gttacctaccggtaggagccagt

SEQ ID NO: 16934 - DNA, 23 bp, Artificial Sequence
  Synthetic construct
gttacctacgggtaggagccagt

SEQ ID NO: 16935 - DNA, 23 bp, Artificial Sequence
  Synthetic construct
gttacctactggtaggagccagt

SEQ ID NO: 16936 - DNA, 23 bp, Artificial Sequence
  Synthetic construct
gttacctacaagtaggagccagt

SEQ ID NO: 16937 - DNA, 23 bp, Artificial Sequence
  Synthetic construct
gttacctacacgtaggagccagt

SEQ ID NO: 16938 - DNA, 23 bp, Artificial Sequence
  Synthetic construct
gttacctacatgtaggagccagt

SEQ ID NO: 16939 - DNA, 23 bp, Artificial Sequence
  Synthetic construct
gttacctacagataggagccagt

SEQ ID NO: 16940 - DNA, 23 bp, Artificial Sequence
  Synthetic construct
gttacctacagctaggagccagt

SEQ ID NO: 16941 - DNA, 23 bp, Artificial Sequence
  Synthetic construct
gttacctacagttaggagccagt

SEQ ID NO: 16942 - DNA, 23 bp, Artificial Sequence
  Synthetic construct
gttacctacaggaaggagccagt

SEQ ID NO: 16943 - DNA, 23 bp, Artificial Sequence
  Synthetic construct
gttacctacaggcaggagccagt

SEQ ID NO: 16944 - DNA, 23 bp, Artificial Sequence
  Synthetic construct
gttacctacagggaggagccagt

SEQ ID NO: 16945 - DNA, 23 bp, Artificial Sequence
  Synthetic construct
gttacctacaggtcggagccagt

SEQ ID NO: 16946 - DNA, 23 bp, Artificial Sequence
  Synthetic construct
gttacctacaggtgggagccagt

SEQ ID NO: 16947 - DNA, 23 bp, Artificial Sequence
  Synthetic construct
gttacctacaggttggagccagt

SEQ ID NO: 16948 - DNA, 23 bp, Artificial Sequence
  Synthetic construct
gttacctacaggtaagagccagt

SEQ ID NO: 16949 - DNA, 23 bp, Artificial Sequence
  Synthetic construct
gttacctacaggtacgagccagt

SEQ ID NO: 16950 - DNA, 23 bp, Artificial Sequence
  Synthetic construct
gttacctacaggtatgagccagt

SEQ ID NO: 16951 - DNA, 23 bp, Artificial Sequence
  Synthetic construct
gttacctacaggtagaagccagt

SEQ ID NO: 16952 - DNA, 23 bp, Artificial Sequence
  Synthetic construct
gttacctacaggtagcagccagt

SEQ ID NO: 16953 - DNA, 23 bp, Artificial Sequence
  Synthetic construct
gttacctacaggtagtagccagt

SEQ ID NO: 16954 - DNA, 23 bp, Artificial Sequence
  Synthetic construct
gttacctacaggtaggcgccagt

SEQ ID NO: 16955 - DNA, 23 bp, Artificial Sequence
  Synthetic construct
gttacctacaggtaggggccagt

SEQ ID NO: 16956 - DNA, 23 bp, Artificial Sequence
  Synthetic construct
gttacctacaggtaggtgccagt

SEQ ID NO: 16957 - DNA, 23 bp, Artificial Sequence
  Synthetic construct
gttacctacaggtaggaaccagt

SEQ ID NO: 16958 - DNA, 23 bp, Artificial Sequence
  Synthetic construct
gttacctacaggtaggacccagt

SEQ ID NO: 16959 - DNA, 23 bp, Artificial Sequence
  Synthetic construct
gttacctacaggtaggatccagt

SEQ ID NO: 16960 - DNA, 23 bp, Artificial Sequence
  Synthetic construct
gttacctacaggtaggagacagt

SEQ ID NO: 16961 - DNA, 23 bp, Artificial Sequence
  Synthetic construct
gttacctacaggtaggaggcagt

SEQ ID NO: 16962 - DNA, 23 bp, Artificial Sequence
  Synthetic construct
gttacctacaggtaggagtcagt

SEQ ID NO: 16963 - DNA, 23 bp, Artificial Sequence
  Synthetic construct
gttacctacaggtaggagcaagt

SEQ ID NO: 16964 - DNA, 23 bp, Artificial Sequence
  Synthetic construct
gttacctacaggtaggagcgagt

SEQ ID NO: 16965 - DNA, 23 bp, Artificial Sequence
  Synthetic construct
gttacctacaggtaggagctagt

SEQ ID NO: 16966 - DNA, 23 bp, Artificial Sequence
  Synthetic construct
gttacctacaggtaggagcccgt

SEQ ID NO: 16967 - DNA, 23 bp, Artificial Sequence
  Synthetic construct
gttacctacaggtaggagccggt

SEQ ID NO: 16968 - DNA, 23 bp, Artificial Sequence
  Synthetic construct
gttacctacaggtaggagcctgt

SEQ ID NO: 16969 - DNA, 23 bp, Artificial Sequence
  Synthetic construct
gttacctacaggtaggagccaat

SEQ ID NO: 16970 - DNA, 23 bp, Artificial Sequence
  Synthetic construct
gttacctacaggtaggagccact

SEQ ID NO: 16971 - DNA, 23 bp, Artificial Sequence
  Synthetic construct
gttacctacaggtaggagccatt

SEQ ID NO: 16972 - DNA, 23 bp, Artificial Sequence
  Synthetic construct
gttacctacaggtaggagccaga

SEQ ID NO: 16973 - DNA, 23 bp, Artificial Sequence
  Synthetic construct
gttacctacaggtaggagccagc

SEQ ID NO: 16974 - DNA, 23 bp, Artificial Sequence
  Synthetic construct
gttacctacaggtaggagccagg

SEQ ID NO: 16975 - DNA, 22 bp, Artificial Sequence
  Synthetic construct
acggatcaccgcttccagtagc

SEQ ID NO: 16976 - DNA, 22 bp, Artificial Sequence
  Synthetic construct
ccggatcaccgcttccagtagc

SEQ ID NO: 16977 - DNA, 22 bp, Artificial Sequence
  Synthetic construct
tcggatcaccgcttccagtagc

SEQ ID NO: 16978 - DNA, 22 bp, Artificial Sequence
  Synthetic construct
gaggatcaccgcttccagtagc

SEQ ID NO: 16979 - DNA, 22 bp, Artificial Sequence
  Synthetic construct
ggggatcaccgcttccagtagc

SEQ ID NO: 16980 - DNA, 22 bp, Artificial Sequence
  Synthetic construct
gtggatcaccgcttccagtagc

SEQ ID NO: 16981 - DNA, 22 bp, Artificial Sequence
  Synthetic construct
gcagatcaccgcttccagtagc

SEQ ID NO: 16982 - DNA, 22 bp, Artificial Sequence
  Synthetic construct
gccgatcaccgcttccagtagc

SEQ ID NO: 16983 - DNA, 22 bp, Artificial Sequence
  Synthetic construct
gctgatcaccgcttccagtagc

SEQ ID NO: 16984 - DNA, 22 bp, Artificial Sequence
  Synthetic construct
gcgaatcaccgcttccagtagc

SEQ ID NO: 16985 - DNA, 22 bp, Artificial Sequence
  Synthetic construct
gcgcatcaccgcttccagtagc

SEQ ID NO: 16986 - DNA, 22 bp, Artificial Sequence
  Synthetic construct
gcgtatcaccgcttccagtagc

SEQ ID NO: 16987 - DNA, 22 bp, Artificial Sequence
  Synthetic construct
gcggctcaccgcttccagtagc

SEQ ID NO: 16988 - DNA, 22 bp, Artificial Sequence
  Synthetic construct
gcgggtcaccgcttccagtagc

SEQ ID NO: 16989 - DNA, 22 bp, Artificial Sequence
  Synthetic construct
gcggttcaccgcttccagtagc

SEQ ID NO: 16990 - DNA, 22 bp, Artificial Sequence
  Synthetic construct
gcggaacaccgcttccagtagc

SEQ ID NO: 16991 - DNA, 22 bp, Artificial Sequence
  Synthetic construct
gcggaccaccgcttccagtagc

SEQ ID NO: 16992 - DNA, 22 bp, Artificial Sequence
  Synthetic construct
gcggagcaccgcttccagtagc

SEQ ID NO: 16993 - DNA, 22 bp, Artificial Sequence
  Synthetic construct
gcggataaccgcttccagtagc

SEQ ID NO: 16994 - DNA, 22 bp, Artificial Sequence
  Synthetic construct
gcggatgaccgcttccagtagc

SEQ ID NO: 16995 - DNA, 22 bp, Artificial Sequence
  Synthetic construct
gcggattaccgcttccagtagc

SEQ ID NO: 16996 - DNA, 22 bp, Artificial Sequence
  Synthetic construct
gcggatccccgcttccagtagc

SEQ ID NO: 16997 - DNA, 22 bp, Artificial Sequence
  Synthetic construct
gcggatcgccgcttccagtagc

SEQ ID NO: 16998 - DNA, 22 bp, Artificial Sequence
  Synthetic construct
gcggatctccgcttccagtagc

SEQ ID NO: 16999 - DNA, 22 bp, Artificial Sequence
  Synthetic construct
gcggatcaacgcttccagtagc

SEQ ID NO: 17000 - DNA, 22 bp, Artificial Sequence
  Synthetic construct
gcggatcagcgcttccagtagc

SEQ ID NO: 17001 - DNA, 22 bp, Artificial Sequence
  Synthetic construct
gcggatcatcgcttccagtagc

SEQ ID NO: 17002 - DNA, 22 bp, Artificial Sequence
  Synthetic construct
gcggatcacagcttccagtagc

SEQ ID NO: 17003 - DNA, 22 bp, Artificial Sequence
  Synthetic construct
gcggatcacggcttccagtagc

SEQ ID NO: 17004 - DNA, 22 bp, Artificial Sequence
  Synthetic construct
gcggatcactgcttccagtagc

SEQ ID NO: 17005 - DNA, 22 bp, Artificial Sequence
  Synthetic construct
gcggatcaccacttccagtagc

SEQ ID NO: 17006 - DNA, 22 bp, Artificial Sequence
  Synthetic construct
gcggatcaccccttccagtagc

SEQ ID NO: 17007 - DNA, 22 bp, Artificial Sequence
  Synthetic construct
gcggatcacctcttccagtagc

SEQ ID NO: 17008 - DNA, 22 bp, Artificial Sequence
  Synthetic construct
gcggatcaccgattccagtagc

SEQ ID NO: 17009 - DNA, 22 bp, Artificial Sequence
  Synthetic construct
gcggatcaccggttccagtagc

SEQ ID NO: 17010 - DNA, 22 bp, Artificial Sequence
  Synthetic construct
gcggatcaccgtttccagtagc

SEQ ID NO: 17011 - DNA, 22 bp, Artificial Sequence
  Synthetic construct
gcggatcaccgcatccagtagc

SEQ ID NO: 17012 - DNA, 22 bp, Artificial Sequence
  Synthetic construct
gcggatcaccgcctccagtagc

SEQ ID NO: 17013 - DNA, 22 bp, Artificial Sequence
  Synthetic construct
gcggatcaccgcgtccagtagc

SEQ ID NO: 17014 - DNA, 22 bp, Artificial Sequence
  Synthetic construct
gcggatcaccgctaccagtagc

SEQ ID NO: 17015 - DNA, 22 bp, Artificial Sequence
  Synthetic construct
gcggatcaccgctcccagtagc

SEQ ID NO: 17016 - DNA, 22 bp, Artificial Sequence
  Synthetic construct
gcggatcaccgctgccagtagc

SEQ ID NO: 17017 - DNA, 22 bp, Artificial Sequence
  Synthetic construct
gcggatcaccgcttacagtagc

SEQ ID NO: 17018 - DNA, 22 bp, Artificial Sequence
  Synthetic construct
gcggatcaccgcttgcagtagc

SEQ ID NO: 17019 - DNA, 22 bp, Artificial Sequence
  Synthetic construct
gcggatcaccgctttcagtagc

SEQ ID NO: 17020 - DNA, 22 bp, Artificial Sequence
  Synthetic construct
gcggatcaccgcttcaagtagc

SEQ ID NO: 17021 - DNA, 22 bp, Artificial Sequence
  Synthetic construct
gcggatcaccgcttcgagtagc

SEQ ID NO: 17022 - DNA, 22 bp, Artificial Sequence
  Synthetic construct
gcggatcaccgcttctagtagc

SEQ ID NO: 17023 - DNA, 22 bp, Artificial Sequence
  Synthetic construct
gcggatcaccgcttcccgtagc

SEQ ID NO: 17024 - DNA, 22 bp, Artificial Sequence
  Synthetic construct
gcggatcaccgcttccggtagc

SEQ ID NO: 17025 - DNA, 22 bp, Artificial Sequence
  Synthetic construct
gcggatcaccgcttcctgtagc

SEQ ID NO: 17026 - DNA, 22 bp, Artificial Sequence
  Synthetic construct
gcggatcaccgcttccaatagc

SEQ ID NO: 17027 - DNA, 22 bp, Artificial Sequence
  Synthetic construct
gcggatcaccgcttccactagc

SEQ ID NO: 17028 - DNA, 22 bp, Artificial Sequence
  Synthetic construct
gcggatcaccgcttccattagc

SEQ ID NO: 17029 - DNA, 22 bp, Artificial Sequence
  Synthetic construct
gcggatcaccgcttccagaagc

SEQ ID NO: 17030 - DNA, 22 bp, Artificial Sequence
  Synthetic construct
gcggatcaccgcttccagcagc

SEQ ID NO: 17031 - DNA, 22 bp, Artificial Sequence
  Synthetic construct
gcggatcaccgcttccaggagc

SEQ ID NO: 17032 - DNA, 22 bp, Artificial Sequence
  Synthetic construct
gcggatcaccgcttccagtcgc

SEQ ID NO: 17033 - DNA, 22 bp, Artificial Sequence
  Synthetic construct
gcggatcaccgcttccagtggc

SEQ ID NO: 17034 - DNA, 22 bp, Artificial Sequence
  Synthetic construct
gcggatcaccgcttccagttgc

SEQ ID NO: 17035 - DNA, 22 bp, Artificial Sequence
  Synthetic construct
gcggatcaccgcttccagtaac

SEQ ID NO: 17036 - DNA, 22 bp, Artificial Sequence
  Synthetic construct
gcggatcaccgcttccagtacc

SEQ ID NO: 17037 - DNA, 22 bp, Artificial Sequence
  Synthetic construct
gcggatcaccgcttccagtatc

SEQ ID NO: 17038 - DNA, 22 bp, Artificial Sequence
  Synthetic construct
gcggatcaccgcttccagtaga

SEQ ID NO: 17039 - DNA, 22 bp, Artificial Sequence
  Synthetic construct
gcggatcaccgcttccagtagg

SEQ ID NO: 17040 - DNA, 22 bp, Artificial Sequence
  Synthetic construct
gcggatcaccgcttccagtagt

SEQ ID NO: 17041 - DNA, 21 bp, Artificial Sequence
  Synthetic construct
cccaacggatttgagccggcg

SEQ ID NO: 17042 - DNA, 21 bp, Artificial Sequence
  Synthetic construct
gccaacggatttgagccggcg

SEQ ID NO: 17043 - DNA, 21 bp, Artificial Sequence
  Synthetic construct
tccaacggatttgagccggcg

SEQ ID NO: 17044 - DNA, 21 bp, Artificial Sequence
  Synthetic construct
aacaacggatttgagccggcg

SEQ ID NO: 17045 - DNA, 21 bp, Artificial Sequence
  Synthetic construct
agcaacggatttgagccggcg

SEQ ID NO: 17046 - DNA, 21 bp, Artificial Sequence
  Synthetic construct
atcaacggatttgagccggcg

SEQ ID NO: 17047 - DNA, 21 bp, Artificial Sequence
  Synthetic construct
acaaacggatttgagccggcg

SEQ ID NO: 17048 - DNA, 21 bp, Artificial Sequence
  Synthetic construct
acgaacggatttgagccggcg

SEQ ID NO: 17049 - DNA, 21 bp, Artificial Sequence
  Synthetic construct
actaacggatttgagccggcg

SEQ ID NO: 17050 - DNA, 21 bp, Artificial Sequence
  Synthetic construct
acccacggatttgagccggcg

SEQ ID NO: 17051 - DNA, 21 bp, Artificial Sequence
  Synthetic construct
accgacggatttgagccggcg

SEQ ID NO: 17052 - DNA, 21 bp, Artificial Sequence
  Synthetic construct
acctacggatttgagccggcg

SEQ ID NO: 17053 - DNA, 21 bp, Artificial Sequence
  Synthetic construct
accaccggatttgagccggcg

SEQ ID NO: 17054 - DNA, 21 bp, Artificial Sequence
  Synthetic construct
accagcggatttgagccggcg

SEQ ID NO: 17055 - DNA, 21 bp, Artificial Sequence
  Synthetic construct
accatcggatttgagccggcg

SEQ ID NO: 17056 - DNA, 21 bp, Artificial Sequence
  Synthetic construct
accaaaggatttgagccggcg

SEQ ID NO: 17057 - DNA, 21 bp, Artificial Sequence
  Synthetic construct
accaagggatttgagccggcg

SEQ ID NO: 17058 - DNA, 21 bp, Artificial Sequence
  Synthetic construct
accaatggatttgagccggcg

SEQ ID NO: 17059 - DNA, 21 bp, Artificial Sequence
  Synthetic construct
accaacagatttgagccggcg

SEQ ID NO: 17060 - DNA, 21 bp, Artificial Sequence
  Synthetic construct
accaaccgatttgagccggcg

SEQ ID NO: 17061 - DNA, 21 bp, Artificial Sequence
  Synthetic construct
accaactgatttgagccggcg

SEQ ID NO: 17062 - DNA, 21 bp, Artificial Sequence
  Synthetic construct
accaacgaatttgagccggcg

SEQ ID NO: 17063 - DNA, 21 bp, Artificial Sequence
  Synthetic construct
accaacgcatttgagccggcg

SEQ ID NO: 17064 - DNA, 21 bp, Artificial Sequence
  Synthetic construct
accaacgtatttgagccggcg

SEQ ID NO: 17065 - DNA, 21 bp, Artificial Sequence
  Synthetic construct
accaacggctttgagccggcg

SEQ ID NO: 17066 - DNA, 21 bp, Artificial Sequence
  Synthetic construct
accaacgggtttgagccggcg

SEQ ID NO: 17067 - DNA, 21 bp, Artificial Sequence
  Synthetic construct
accaacggttttgagccggcg

SEQ ID NO: 17068 - DNA, 21 bp, Artificial Sequence
  Synthetic construct
accaacggaattgagccggcg

SEQ ID NO: 17069 - DNA, 21 bp, Artificial Sequence
  Synthetic construct
accaacggacttgagccggcg

SEQ ID NO: 17070 - DNA, 21 bp, Artificial Sequence
  Synthetic construct
accaacggagttgagccggcg

SEQ ID NO: 17071 - DNA, 21 bp, Artificial Sequence
  Synthetic construct
accaacggatatgagccggcg

SEQ ID NO: 17072 - DNA, 21 bp, Artificial Sequence
  Synthetic construct
accaacggatctgagccggcg

SEQ ID NO: 17073 - DNA, 21 bp, Artificial Sequence
  Synthetic construct
accaacggatgtgagccggcg

SEQ ID NO: 17074 - DNA, 21 bp, Artificial Sequence
  Synthetic construct
accaacggattagagccggcg

SEQ ID NO: 17075 - DNA, 21 bp, Artificial Sequence
  Synthetic construct
accaacggattcgagccggcg

SEQ ID NO: 17076 - DNA, 21 bp, Artificial Sequence
  Synthetic construct
accaacggattggagccggcg

SEQ ID NO: 17077 - DNA, 21 bp, Artificial Sequence
  Synthetic construct
accaacggatttaagccggcg

SEQ ID NO: 17078 - DNA, 21 bp, Artificial Sequence
  Synthetic construct
accaacggatttcagccggcg

SEQ ID NO: 17079 - DNA, 21 bp, Artificial Sequence
  Synthetic construct
accaacggattttagccggcg

SEQ ID NO: 17080 - DNA, 21 bp, Artificial Sequence
  Synthetic construct
accaacggatttgcgccggcg

SEQ ID NO: 17081 - DNA, 21 bp, Artificial Sequence
  Synthetic construct
accaacggatttgggccggcg

SEQ ID NO: 17082 - DNA, 21 bp, Artificial Sequence
  Synthetic construct
accaacggatttgtgccggcg

SEQ ID NO: 17083 - DNA, 21 bp, Artificial Sequence
  Synthetic construct
accaacggatttgaaccggcg

SEQ ID NO: 17084 - DNA, 21 bp, Artificial Sequence
  Synthetic construct
accaacggatttgacccggcg

SEQ ID NO: 17085 - DNA, 21 bp, Artificial Sequence
  Synthetic construct
accaacggatttgatccggcg

SEQ ID NO: 17086 - DNA, 21 bp, Artificial Sequence
  Synthetic construct
accaacggatttgagacggcg

SEQ ID NO: 17087 - DNA, 21 bp, Artificial Sequence
  Synthetic construct
accaacggatttgaggcggcg

SEQ ID NO: 17088 - DNA, 21 bp, Artificial Sequence
  Synthetic construct
accaacggatttgagtcggcg

SEQ ID NO: 17089 - DNA, 21 bp, Artificial Sequence
  Synthetic construct
accaacggatttgagcaggcg

SEQ ID NO: 17090 - DNA, 21 bp, Artificial Sequence
  Synthetic construct
accaacggatttgagcgggcg

SEQ ID NO: 17091 - DNA, 21 bp, Artificial Sequence
  Synthetic construct
accaacggatttgagctggcg

SEQ ID NO: 17092 - DNA, 21 bp, Artificial Sequence
  Synthetic construct
accaacggatttgagccagcg

SEQ ID NO: 17093 - DNA, 21 bp, Artificial Sequence
  Synthetic construct
accaacggatttgagcccgcg

SEQ ID NO: 17094 - DNA, 21 bp, Artificial Sequence
  Synthetic construct
accaacggatttgagcctgcg

SEQ ID NO: 17095 - DNA, 21 bp, Artificial Sequence
  Synthetic construct
accaacggatttgagccgacg

SEQ ID NO: 17096 - DNA, 21 bp, Artificial Sequence
  Synthetic construct
accaacggatttgagccgccg

SEQ ID NO: 17097 - DNA, 21 bp, Artificial Sequence
  Synthetic construct
accaacggatttgagccgtcg

SEQ ID NO: 17098 - DNA, 21 bp, Artificial Sequence
  Synthetic construct
accaacggatttgagccggag

SEQ ID NO: 17099 - DNA, 21 bp, Artificial Sequence
  Synthetic construct
accaacggatttgagccgggg

SEQ ID NO: 17100 - DNA, 21 bp, Artificial Sequence
  Synthetic construct
accaacggatttgagccggtg

SEQ ID NO: 17101 - DNA, 21 bp, Artificial Sequence
  Synthetic construct
accaacggatttgagccggca

SEQ ID NO: 17102 - DNA, 21 bp, Artificial Sequence
  Synthetic construct
accaacggatttgagccggcc

SEQ ID NO: 17103 - DNA, 21 bp, Artificial Sequence
  Synthetic construct
accaacggatttgagccggct

SEQ ID NO: 17104 - DNA, 22 bp, Artificial Sequence
  Synthetic construct
cagcctgtgaacgcgagttaga

SEQ ID NO: 17105 - DNA, 22 bp, Artificial Sequence
  Synthetic construct
gagcctgtgaacgcgagttaga

SEQ ID NO: 17106 - DNA, 22 bp, Artificial Sequence
  Synthetic construct
tagcctgtgaacgcgagttaga

SEQ ID NO: 17107 - DNA, 22 bp, Artificial Sequence
  Synthetic construct
acgcctgtgaacgcgagttaga

SEQ ID NO: 17108 - DNA, 22 bp, Artificial Sequence
  Synthetic construct
aggcctgtgaacgcgagttaga

SEQ ID NO: 17109 - DNA, 22 bp, Artificial Sequence
  Synthetic construct
atgcctgtgaacgcgagttaga

SEQ ID NO: 17110 - DNA, 22 bp, Artificial Sequence
  Synthetic construct
aaacctgtgaacgcgagttaga

SEQ ID NO: 17111 - DNA, 22 bp, Artificial Sequence
  Synthetic construct
aaccctgtgaacgcgagttaga

SEQ ID NO: 17112 - DNA, 22 bp, Artificial Sequence
  Synthetic construct
aatcctgtgaacgcgagttaga

SEQ ID NO: 17113 - DNA, 22 bp, Artificial Sequence
  Synthetic construct
aagactgtgaacgcgagttaga

SEQ ID NO: 17114 - DNA, 22 bp, Artificial Sequence
  Synthetic construct
aaggctgtgaacgcgagttaga

SEQ ID NO: 17115 - DNA, 22 bp, Artificial Sequence
  Synthetic construct
aagtctgtgaacgcgagttaga

SEQ ID NO: 17116 - DNA, 22 bp, Artificial Sequence
  Synthetic construct
aagcatgtgaacgcgagttaga

SEQ ID NO: 17117 - DNA, 22 bp, Artificial Sequence
  Synthetic construct
aagcgtgtgaacgcgagttaga

SEQ ID NO: 17118 - DNA, 22 bp, Artificial Sequence
  Synthetic construct
aagcttgtgaacgcgagttaga

SEQ ID NO: 17119 - DNA, 22 bp, Artificial Sequence
  Synthetic construct
aagccagtgaacgcgagttaga

SEQ ID NO: 17120 - DNA, 22 bp, Artificial Sequence
  Synthetic construct
aagcccgtgaacgcgagttaga

SEQ ID NO: 17121 - DNA, 22 bp, Artificial Sequence
  Synthetic construct
aagccggtgaacgcgagttaga

SEQ ID NO: 17122 - DNA, 22 bp, Artificial Sequence
  Synthetic construct
aagcctatgaacgcgagttaga

SEQ ID NO: 17123 - DNA, 22 bp, Artificial Sequence
  Synthetic construct
aagcctctgaacgcgagttaga

SEQ ID NO: 17124 - DNA, 22 bp, Artificial Sequence
  Synthetic construct
aagcctttgaacgcgagttaga

SEQ ID NO: 17125 - DNA, 22 bp, Artificial Sequence
  Synthetic construct
aagcctgagaacgcgagttaga

SEQ ID NO: 17126 - DNA, 22 bp, Artificial Sequence
  Synthetic construct
aagcctgcgaacgcgagttaga

SEQ ID NO: 17127 - DNA, 22 bp, Artificial Sequence
  Synthetic construct
aagcctgggaacgcgagttaga

SEQ ID NO: 17128 - DNA, 22 bp, Artificial Sequence
  Synthetic construct
aagcctgtaaacgcgagttaga

SEQ ID NO: 17129 - DNA, 22 bp, Artificial Sequence
  Synthetic construct
aagcctgtcaacgcgagttaga

SEQ ID NO: 17130 - DNA, 22 bp, Artificial Sequence
  Synthetic construct
aagcctgttaacgcgagttaga

SEQ ID NO: 17131 - DNA, 22 bp, Artificial Sequence
  Synthetic construct
aagcctgtgcacgcgagttaga

SEQ ID NO: 17132 - DNA, 22 bp, Artificial Sequence
  Synthetic construct
aagcctgtggacgcgagttaga

SEQ ID NO: 17133 - DNA, 22 bp, Artificial Sequence
  Synthetic construct
aagcctgtgtacgcgagttaga

SEQ ID NO: 17134 - DNA, 22 bp, Artificial Sequence
  Synthetic construct
aagcctgtgaccgcgagttaga

SEQ ID NO: 17135 - DNA, 22 bp, Artificial Sequence
  Synthetic construct
aagcctgtgagcgcgagttaga

SEQ ID NO: 17136 - DNA, 22 bp, Artificial Sequence
  Synthetic construct
aagcctgtgatcgcgagttaga

SEQ ID NO: 17137 - DNA, 22 bp, Artificial Sequence
  Synthetic construct
aagcctgtgaaagcgagttaga

SEQ ID NO: 17138 - DNA, 22 bp, Artificial Sequence
  Synthetic construct
aagcctgtgaaggcgagttaga

SEQ ID NO: 17139 - DNA, 22 bp, Artificial Sequence
  Synthetic construct
aagcctgtgaatgcgagttaga

SEQ ID NO: 17140 - DNA, 22 bp, Artificial Sequence
  Synthetic construct
aagcctgtgaacacgagttaga

SEQ ID NO: 17141 - DNA, 22 bp, Artificial Sequence
  Synthetic construct
aagcctgtgaacccgagttaga

SEQ ID NO: 17142 - DNA, 22 bp, Artificial Sequence
  Synthetic construct
aagcctgtgaactcgagttaga

SEQ ID NO: 17143 - DNA, 22 bp, Artificial Sequence
  Synthetic construct
aagcctgtgaacgagagttaga

SEQ ID NO: 17144 - DNA, 22 bp, Artificial Sequence
  Synthetic construct
aagcctgtgaacgggagttaga

SEQ ID NO: 17145 - DNA, 22 bp, Artificial Sequence
  Synthetic construct
aagcctgtgaacgtgagttaga

SEQ ID NO: 17146 - DNA, 22 bp, Artificial Sequence
  Synthetic construct
aagcctgtgaacgcaagttaga

SEQ ID NO: 17147 - DNA, 22 bp, Artificial Sequence
  Synthetic construct
aagcctgtgaacgccagttaga

SEQ ID NO: 17148 - DNA, 22 bp, Artificial Sequence
  Synthetic construct
aagcctgtgaacgctagttaga

SEQ ID NO: 17149 - DNA, 22 bp, Artificial Sequence
  Synthetic construct
aagcctgtgaacgcgcgttaga

SEQ ID NO: 17150 - DNA, 22 bp, Artificial Sequence
  Synthetic construct
aagcctgtgaacgcgggttaga

SEQ ID NO: 17151 - DNA, 22 bp, Artificial Sequence
  Synthetic construct
aagcctgtgaacgcgtgttaga

SEQ ID NO: 17152 - DNA, 22 bp, Artificial Sequence
  Synthetic construct
aagcctgtgaacgcgaattaga

SEQ ID NO: 17153 - DNA, 22 bp, Artificial Sequence
  Synthetic construct
aagcctgtgaacgcgacttaga

SEQ ID NO: 17154 - DNA, 22 bp, Artificial Sequence
  Synthetic construct
aagcctgtgaacgcgatttaga

SEQ ID NO: 17155 - DNA, 22 bp, Artificial Sequence
  Synthetic construct
aagcctgtgaacgcgagataga

SEQ ID NO: 17156 - DNA, 22 bp, Artificial Sequence
  Synthetic construct
aagcctgtgaacgcgagctaga

SEQ ID NO: 17157 - DNA, 22 bp, Artificial Sequence
  Synthetic construct
aagcctgtgaacgcgaggtaga

SEQ ID NO: 17158 - DNA, 22 bp, Artificial Sequence
  Synthetic construct
aagcctgtgaacgcgagtaaga

SEQ ID NO: 17159 - DNA, 22 bp, Artificial Sequence
  Synthetic construct
aagcctgtgaacgcgagtcaga

SEQ ID NO: 17160 - DNA, 22 bp, Artificial Sequence
  Synthetic construct
aagcctgtgaacgcgagtgaga

SEQ ID NO: 17161 - DNA, 22 bp, Artificial Sequence
  Synthetic construct
aagcctgtgaacgcgagttcga

SEQ ID NO: 17162 - DNA, 22 bp, Artificial Sequence
  Synthetic construct
aagcctgtgaacgcgagttgga

SEQ ID NO: 17163 - DNA, 22 bp, Artificial Sequence
  Synthetic construct
aagcctgtgaacgcgagtttga

SEQ ID NO: 17164 - DNA, 22 bp, Artificial Sequence
  Synthetic construct
aagcctgtgaacgcgagttaaa

SEQ ID NO: 17165 - DNA, 22 bp, Artificial Sequence
  Synthetic construct
aagcctgtgaacgcgagttaca

SEQ ID NO: 17166 - DNA, 22 bp, Artificial Sequence
  Synthetic construct
aagcctgtgaacgcgagttata

SEQ ID NO: 17167 - DNA, 22 bp, Artificial Sequence
  Synthetic construct
aagcctgtgaacgcgagttagc

SEQ ID NO: 17168 - DNA, 22 bp, Artificial Sequence
  Synthetic construct
aagcctgtgaacgcgagttagg

SEQ ID NO: 17169 - DNA, 22 bp, Artificial Sequence
  Synthetic construct
aagcctgtgaacgcgagttagt

SEQ ID NO: 17170 - DNA, 20 bp, Artificial Sequence
  Synthetic construct
agcaacgttctgcggcactt

SEQ ID NO: 17171 - DNA, 20 bp, Artificial Sequence
  Synthetic construct
ggcaacgttctgcggcactt

SEQ ID NO: 17172 - DNA, 20 bp, Artificial Sequence
  Synthetic construct
tgcaacgttctgcggcactt

SEQ ID NO: 17173 - DNA, 20 bp, Artificial Sequence
  Synthetic construct
cacaacgttctgcggcactt

SEQ ID NO: 17174 - DNA, 20 bp, Artificial Sequence
  Synthetic construct
cccaacgttctgcggcactt

SEQ ID NO: 17175 - DNA, 20 bp, Artificial Sequence
  Synthetic construct
ctcaacgttctgcggcactt

SEQ ID NO: 17176 - DNA, 20 bp, Artificial Sequence
  Synthetic construct
cgaaacgttctgcggcactt

SEQ ID NO: 17177 - DNA, 20 bp, Artificial Sequence
  Synthetic construct
cggaacgttctgcggcactt

SEQ ID NO: 17178 - DNA, 20 bp, Artificial Sequence
  Synthetic construct
cgtaacgttctgcggcactt

SEQ ID NO: 17179 - DNA, 20 bp, Artificial Sequence
  Synthetic construct
cgccacgttctgcggcactt

SEQ ID NO: 17180 - DNA, 20 bp, Artificial Sequence
  Synthetic construct
cgcgacgttctgcggcactt

SEQ ID NO: 17181 - DNA, 20 bp, Artificial Sequence
  Synthetic construct
cgctacgttctgcggcactt

SEQ ID NO: 17182 - DNA, 20 bp, Artificial Sequence
  Synthetic construct
cgcaccgttctgcggcactt

SEQ ID NO: 17183 - DNA, 20 bp, Artificial Sequence
  Synthetic construct
cgcagcgttctgcggcactt

SEQ ID NO: 17184 - DNA, 20 bp, Artificial Sequence
  Synthetic construct
cgcatcgttctgcggcactt

SEQ ID NO: 17185 - DNA, 20 bp, Artificial Sequence
  Synthetic construct
cgcaaagttctgcggcactt

SEQ ID NO: 17186 - DNA, 20 bp, Artificial Sequence
  Synthetic construct
cgcaaggttctgcggcactt

SEQ ID NO: 17187 - DNA, 20 bp, Artificial Sequence
  Synthetic construct
cgcaatgttctgcggcactt

SEQ ID NO: 17188 - DNA, 20 bp, Artificial Sequence
  Synthetic construct
cgcaacattctgcggcactt

SEQ ID NO: 17189 - DNA, 20 bp, Artificial Sequence
  Synthetic construct
cgcaaccttctgcggcactt

SEQ ID NO: 17190 - DNA, 20 bp, Artificial Sequence
  Synthetic construct
cgcaactttctgcggcactt

SEQ ID NO: 17191 - DNA, 20 bp, Artificial Sequence
  Synthetic construct
cgcaacgatctgcggcactt

SEQ ID NO: 17192 - DNA, 20 bp, Artificial Sequence
  Synthetic construct
cgcaacgctctgcggcactt

SEQ ID NO: 17193 - DNA, 20 bp, Artificial Sequence
  Synthetic construct
cgcaacggtctgcggcactt

SEQ ID NO: 17194 - DNA, 20 bp, Artificial Sequence
  Synthetic construct
cgcaacgtactgcggcactt

SEQ ID NO: 17195 - DNA, 20 bp, Artificial Sequence
  Synthetic construct
cgcaacgtcctgcggcactt

SEQ ID NO: 17196 - DNA, 20 bp, Artificial Sequence
  Synthetic construct
cgcaacgtgctgcggcactt

SEQ ID NO: 17197 - DNA, 20 bp, Artificial Sequence
  Synthetic construct
cgcaacgttatgcggcactt

SEQ ID NO: 17198 - DNA, 20 bp, Artificial Sequence
  Synthetic construct
cgcaacgttgtgcggcactt

SEQ ID NO: 17199 - DNA, 20 bp, Artificial Sequence
  Synthetic construct
cgcaacgttttgcggcactt

SEQ ID NO: 17200 - DNA, 20 bp, Artificial Sequence
  Synthetic construct
cgcaacgttcagcggcactt

SEQ ID NO: 17201 - DNA, 20 bp, Artificial Sequence
  Synthetic construct
cgcaacgttccgcggcactt

SEQ ID NO: 17202 - DNA, 20 bp, Artificial Sequence
  Synthetic construct
cgcaacgttcggcggcactt

SEQ ID NO: 17203 - DNA, 20 bp, Artificial Sequence
  Synthetic construct
cgcaacgttctacggcactt

SEQ ID NO: 17204 - DNA, 20 bp, Artificial Sequence
  Synthetic construct
cgcaacgttctccggcactt

SEQ ID NO: 17205 - DNA, 20 bp, Artificial Sequence
  Synthetic construct
cgcaacgttcttcggcactt

SEQ ID NO: 17206 - DNA, 20 bp, Artificial Sequence
  Synthetic construct
cgcaacgttctgaggcactt

SEQ ID NO: 17207 - DNA, 20 bp, Artificial Sequence
  Synthetic construct
cgcaacgttctggggcactt

SEQ ID NO: 17208 - DNA, 20 bp, Artificial Sequence
  Synthetic construct
cgcaacgttctgtggcactt

SEQ ID NO: 17209 - DNA, 20 bp, Artificial Sequence
  Synthetic construct
cgcaacgttctgcagcactt

SEQ ID NO: 17210 - DNA, 20 bp, Artificial Sequence
  Synthetic construct
cgcaacgttctgccgcactt

SEQ ID NO: 17211 - DNA, 20 bp, Artificial Sequence
  Synthetic construct
cgcaacgttctgctgcactt

SEQ ID NO: 17212 - DNA, 20 bp, Artificial Sequence
  Synthetic construct
cgcaacgttctgcgacactt

SEQ ID NO: 17213 - DNA, 20 bp, Artificial Sequence
  Synthetic construct
cgcaacgttctgcgccactt

SEQ ID NO: 17214 - DNA, 20 bp, Artificial Sequence
  Synthetic construct
cgcaacgttctgcgtcactt

SEQ ID NO: 17215 - DNA, 20 bp, Artificial Sequence
  Synthetic construct
cgcaacgttctgcggaactt

SEQ ID NO: 17216 - DNA, 20 bp, Artificial Sequence
  Synthetic construct
cgcaacgttctgcgggactt

SEQ ID NO: 17217 - DNA, 20 bp, Artificial Sequence
  Synthetic construct
cgcaacgttctgcggtactt

SEQ ID NO: 17218 - DNA, 20 bp, Artificial Sequence
  Synthetic construct
cgcaacgttctgcggccctt

SEQ ID NO: 17219 - DNA, 20 bp, Artificial Sequence
  Synthetic construct
cgcaacgttctgcggcgctt

SEQ ID NO: 17220 - DNA, 20 bp, Artificial Sequence
  Synthetic construct
cgcaacgttctgcggctctt

SEQ ID NO: 17221 - DNA, 20 bp, Artificial Sequence
  Synthetic construct
cgcaacgttctgcggcaatt

SEQ ID NO: 17222 - DNA, 20 bp, Artificial Sequence
  Synthetic construct
cgcaacgttctgcggcagtt

SEQ ID NO: 17223 - DNA, 20 bp, Artificial Sequence
  Synthetic construct
cgcaacgttctgcggcattt

SEQ ID NO: 17224 - DNA, 20 bp, Artificial Sequence
  Synthetic construct
cgcaacgttctgcggcacat

SEQ ID NO: 17225 - DNA, 20 bp, Artificial Sequence
  Synthetic construct
cgcaacgttctgcggcacct

SEQ ID NO: 17226 - DNA, 20 bp, Artificial Sequence
  Synthetic construct
cgcaacgttctgcggcacgt

SEQ ID NO: 17227 - DNA, 20 bp, Artificial Sequence
  Synthetic construct
cgcaacgttctgcggcacta

SEQ ID NO: 17228 - DNA, 20 bp, Artificial Sequence
  Synthetic construct
cgcaacgttctgcggcactc

SEQ ID NO: 17229 - DNA, 20 bp, Artificial Sequence
  Synthetic construct
cgcaacgttctgcggcactg

SEQ ID NO: 17230 - DNA, 23 bp, Artificial Sequence
  Synthetic construct
atcaaatgtgaacccatttccca

SEQ ID NO: 17231 - DNA, 23 bp, Artificial Sequence
  Synthetic construct
gtcaaatgtgaacccatttccca

SEQ ID NO: 17232 - DNA, 23 bp, Artificial Sequence
  Synthetic construct
ttcaaatgtgaacccatttccca

SEQ ID NO: 17233 - DNA, 23 bp, Artificial Sequence
  Synthetic construct
cacaaatgtgaacccatttccca

SEQ ID NO: 17234 - DNA, 23 bp, Artificial Sequence
  Synthetic construct
cccaaatgtgaacccatttccca

SEQ ID NO: 17235 - DNA, 23 bp, Artificial Sequence
  Synthetic construct
cgcaaatgtgaacccatttccca

SEQ ID NO: 17236 - DNA, 23 bp, Artificial Sequence
  Synthetic construct
ctaaaatgtgaacccatttccca

SEQ ID NO: 17237 - DNA, 23 bp, Artificial Sequence
  Synthetic construct
ctgaaatgtgaacccatttccca

SEQ ID NO: 17238 - DNA, 23 bp, Artificial Sequence
  Synthetic construct
cttaaatgtgaacccatttccca

SEQ ID NO: 17239 - DNA, 23 bp, Artificial Sequence
  Synthetic construct
ctccaatgtgaacccatttccca

SEQ ID NO: 17240 - DNA, 23 bp, Artificial Sequence
  Synthetic construct
ctcgaatgtgaacccatttccca

SEQ ID NO: 17241 - DNA, 23 bp, Artificial Sequence
  Synthetic construct
ctctaatgtgaacccatttccca

SEQ ID NO: 17242 - DNA, 23 bp, Artificial Sequence
  Synthetic construct
ctcacatgtgaacccatttccca

SEQ ID NO: 17243 - DNA, 23 bp, Artificial Sequence
  Synthetic construct
ctcagatgtgaacccatttccca

SEQ ID NO: 17244 - DNA, 23 bp, Artificial Sequence
  Synthetic construct
ctcatatgtgaacccatttccca

SEQ ID NO: 17245 - DNA, 23 bp, Artificial Sequence
  Synthetic construct
ctcaactgtgaacccatttccca

SEQ ID NO: 17246 - DNA, 23 bp, Artificial Sequence
  Synthetic construct
ctcaagtgtgaacccatttccca

SEQ ID NO: 17247 - DNA, 23 bp, Artificial Sequence
  Synthetic construct
ctcaattgtgaacccatttccca

SEQ ID NO: 17248 - DNA, 23 bp, Artificial Sequence
  Synthetic construct
ctcaaaagtgaacccatttccca

SEQ ID NO: 17249 - DNA, 23 bp, Artificial Sequence
  Synthetic construct
ctcaaacgtgaacccatttccca

SEQ ID NO: 17250 - DNA, 23 bp, Artificial Sequence
  Synthetic construct
ctcaaaggtgaacccatttccca

SEQ ID NO: 17251 - DNA, 23 bp, Artificial Sequence
  Synthetic construct
ctcaaatatgaacccatttccca

SEQ ID NO: 17252 - DNA, 23 bp, Artificial Sequence
  Synthetic construct
ctcaaatctgaacccatttccca

SEQ ID NO: 17253 - DNA, 23 bp, Artificial Sequence
  Synthetic construct
ctcaaatttgaacccatttccca

SEQ ID NO: 17254 - DNA, 23 bp, Artificial Sequence
  Synthetic construct
ctcaaatgagaacccatttccca

SEQ ID NO: 17255 - DNA, 23 bp, Artificial Sequence
  Synthetic construct
ctcaaatgcgaacccatttccca

SEQ ID NO: 17256 - DNA, 23 bp, Artificial Sequence
  Synthetic construct
ctcaaatgggaacccatttccca

SEQ ID NO: 17257 - DNA, 23 bp, Artificial Sequence
  Synthetic construct
ctcaaatgtaaacccatttccca

SEQ ID NO: 17258 - DNA, 23 bp, Artificial Sequence
  Synthetic construct
ctcaaatgtcaacccatttccca

SEQ ID NO: 17259 - DNA, 23 bp, Artificial Sequence
  Synthetic construct
ctcaaatgttaacccatttccca

SEQ ID NO: 17260 - DNA, 23 bp, Artificial Sequence
  Synthetic construct
ctcaaatgtgcacccatttccca

SEQ ID NO: 17261 - DNA, 23 bp, Artificial Sequence
  Synthetic construct
ctcaaatgtggacccatttccca

SEQ ID NO: 17262 - DNA, 23 bp, Artificial Sequence
  Synthetic construct
ctcaaatgtgtacccatttccca

SEQ ID NO: 17263 - DNA, 23 bp, Artificial Sequence
  Synthetic construct
ctcaaatgtgaccccatttccca

SEQ ID NO: 17264 - DNA, 23 bp, Artificial Sequence
  Synthetic construct
ctcaaatgtgagcccatttccca

SEQ ID NO: 17265 - DNA, 23 bp, Artificial Sequence
  Synthetic construct
ctcaaatgtgatcccatttccca

SEQ ID NO: 17266 - DNA, 23 bp, Artificial Sequence
  Synthetic construct
ctcaaatgtgaaaccatttccca

SEQ ID NO: 17267 - DNA, 23 bp, Artificial Sequence
  Synthetic construct
ctcaaatgtgaagccatttccca

SEQ ID NO: 17268 - DNA, 23 bp, Artificial Sequence
  Synthetic construct
ctcaaatgtgaatccatttccca

SEQ ID NO: 17269 - DNA, 23 bp, Artificial Sequence
  Synthetic construct
ctcaaatgtgaacacatttccca

SEQ ID NO: 17270 - DNA, 23 bp, Artificial Sequence
  Synthetic construct
ctcaaatgtgaacgcatttccca

SEQ ID NO: 17271 - DNA, 23 bp, Artificial Sequence
  Synthetic construct
ctcaaatgtgaactcatttccca

SEQ ID NO: 17272 - DNA, 23 bp, Artificial Sequence
  Synthetic construct
ctcaaatgtgaaccaatttccca

SEQ ID NO: 17273 - DNA, 23 bp, Artificial Sequence
  Synthetic construct
ctcaaatgtgaaccgatttccca

SEQ ID NO: 17274 - DNA, 23 bp, Artificial Sequence
  Synthetic construct
ctcaaatgtgaacctatttccca

SEQ ID NO: 17275 - DNA, 23 bp, Artificial Sequence
  Synthetic construct
ctcaaatgtgaacccctttccca

SEQ ID NO: 17276 - DNA, 23 bp, Artificial Sequence
  Synthetic construct
ctcaaatgtgaacccgtttccca

SEQ ID NO: 17277 - DNA, 23 bp, Artificial Sequence
  Synthetic construct
ctcaaatgtgaacccttttccca

SEQ ID NO: 17278 - DNA, 23 bp, Artificial Sequence
  Synthetic construct
ctcaaatgtgaacccaattccca

SEQ ID NO: 17279 - DNA, 23 bp, Artificial Sequence
  Synthetic construct
ctcaaatgtgaacccacttccca

SEQ ID NO: 17280 - DNA, 23 bp, Artificial Sequence
  Synthetic construct
ctcaaatgtgaacccagttccca

SEQ ID NO: 17281 - DNA, 23 bp, Artificial Sequence
  Synthetic construct
ctcaaatgtgaacccatatccca

SEQ ID NO: 17282 - DNA, 23 bp, Artificial Sequence
  Synthetic construct
ctcaaatgtgaacccatctccca

SEQ ID NO: 17283 - DNA, 23 bp, Artificial Sequence
  Synthetic construct
ctcaaatgtgaacccatgtccca

SEQ ID NO: 17284 - DNA, 23 bp, Artificial Sequence
  Synthetic construct
ctcaaatgtgaacccattaccca

SEQ ID NO: 17285 - DNA, 23 bp, Artificial Sequence
  Synthetic construct
ctcaaatgtgaacccattcccca

SEQ ID NO: 17286 - DNA, 23 bp, Artificial Sequence
  Synthetic construct
ctcaaatgtgaacccattgccca

SEQ ID NO: 17287 - DNA, 23 bp, Artificial Sequence
  Synthetic construct
ctcaaatgtgaacccatttacca

SEQ ID NO: 17288 - DNA, 23 bp, Artificial Sequence
  Synthetic construct
ctcaaatgtgaacccatttgcca

SEQ ID NO: 17289 - DNA, 23 bp, Artificial Sequence
  Synthetic construct
ctcaaatgtgaacccattttcca

SEQ ID NO: 17290 - DNA, 23 bp, Artificial Sequence
  Synthetic construct
ctcaaatgtgaacccatttcaca

SEQ ID NO: 17291 - DNA, 23 bp, Artificial Sequence
  Synthetic construct
ctcaaatgtgaacccatttcgca

SEQ ID NO: 17292 - DNA, 23 bp, Artificial Sequence
  Synthetic construct
ctcaaatgtgaacccatttctca

SEQ ID NO: 17293 - DNA, 23 bp, Artificial Sequence
  Synthetic construct
ctcaaatgtgaacccatttccaa

SEQ ID NO: 17294 - DNA, 23 bp, Artificial Sequence
  Synthetic construct
ctcaaatgtgaacccatttccga

SEQ ID NO: 17295 - DNA, 23 bp, Artificial Sequence
  Synthetic construct
ctcaaatgtgaacccatttccta

SEQ ID NO: 17296 - DNA, 23 bp, Artificial Sequence
  Synthetic construct
ctcaaatgtgaacccatttcccc

SEQ ID NO: 17297 - DNA, 23 bp, Artificial Sequence
  Synthetic construct
ctcaaatgtgaacccatttcccg

SEQ ID NO: 17298 - DNA, 23 bp, Artificial Sequence
  Synthetic construct
ctcaaatgtgaacccatttccct

SEQ ID NO: 17299 - DNA, 23 bp, Artificial Sequence
  Synthetic construct
agaacgttttacgaagattcggt

SEQ ID NO: 17300 - DNA, 23 bp, Artificial Sequence
  Synthetic construct
ggaacgttttacgaagattcggt

SEQ ID NO: 17301 - DNA, 23 bp, Artificial Sequence
  Synthetic construct
tgaacgttttacgaagattcggt

SEQ ID NO: 17302 - DNA, 23 bp, Artificial Sequence
  Synthetic construct
caaacgttttacgaagattcggt

SEQ ID NO: 17303 - DNA, 23 bp, Artificial Sequence
  Synthetic construct
ccaacgttttacgaagattcggt

SEQ ID NO: 17304 - DNA, 23 bp, Artificial Sequence
  Synthetic construct
ctaacgttttacgaagattcggt

SEQ ID NO: 17305 - DNA, 23 bp, Artificial Sequence
  Synthetic construct
cgcacgttttacgaagattcggt

SEQ ID NO: 17306 - DNA, 23 bp, Artificial Sequence
  Synthetic construct
cggacgttttacgaagattcggt

SEQ ID NO: 17307 - DNA, 23 bp, Artificial Sequence
  Synthetic construct
cgtacgttttacgaagattcggt

SEQ ID NO: 17308 - DNA, 23 bp, Artificial Sequence
  Synthetic construct
cgaccgttttacgaagattcggt

SEQ ID NO: 17309 - DNA, 23 bp, Artificial Sequence
  Synthetic construct
cgagcgttttacgaagattcggt

SEQ ID NO: 17310 - DNA, 23 bp, Artificial Sequence
  Synthetic construct
cgatcgttttacgaagattcggt

SEQ ID NO: 17311 - DNA, 23 bp, Artificial Sequence
  Synthetic construct
cgaaagttttacgaagattcggt

SEQ ID NO: 17312 - DNA, 23 bp, Artificial Sequence
  Synthetic construct
cgaaggttttacgaagattcggt

SEQ ID NO: 17313 - DNA, 23 bp, Artificial Sequence
  Synthetic construct
cgaatgttttacgaagattcggt

SEQ ID NO: 17314 - DNA, 23 bp, Artificial Sequence
  Synthetic construct
cgaacattttacgaagattcggt

SEQ ID NO: 17315 - DNA, 23 bp, Artificial Sequence
  Synthetic construct
cgaaccttttacgaagattcggt

SEQ ID NO: 17316 - DNA, 23 bp, Artificial Sequence
  Synthetic construct
cgaactttttacgaagattcggt

SEQ ID NO: 17317 - DNA, 23 bp, Artificial Sequence
  Synthetic construct
cgaacgatttacgaagattcggt

SEQ ID NO: 17318 - DNA, 23 bp, Artificial Sequence
  Synthetic construct
cgaacgctttacgaagattcggt

SEQ ID NO: 17319 - DNA, 23 bp, Artificial Sequence
  Synthetic construct
cgaacggtttacgaagattcggt

SEQ ID NO: 17320 - DNA, 23 bp, Artificial Sequence
  Synthetic construct
cgaacgtattacgaagattcggt

SEQ ID NO: 17321 - DNA, 23 bp, Artificial Sequence
  Synthetic construct
cgaacgtcttacgaagattcggt

SEQ ID NO: 17322 - DNA, 23 bp, Artificial Sequence
  Synthetic construct
cgaacgtgttacgaagattcggt

SEQ ID NO: 17323 - DNA, 23 bp, Artificial Sequence
  Synthetic construct
cgaacgttatacgaagattcggt

SEQ ID NO: 17324 - DNA, 23 bp, Artificial Sequence
  Synthetic construct
cgaacgttctacgaagattcggt

SEQ ID NO: 17325 - DNA, 23 bp, Artificial Sequence
  Synthetic construct
cgaacgttgtacgaagattcggt

SEQ ID NO: 17326 - DNA, 23 bp, Artificial Sequence
  Synthetic construct
cgaacgtttaacgaagattcggt

SEQ ID NO: 17327 - DNA, 23 bp, Artificial Sequence
  Synthetic construct
cgaacgtttcacgaagattcggt

SEQ ID NO: 17328 - DNA, 23 bp, Artificial Sequence
  Synthetic construct
cgaacgtttgacgaagattcggt

SEQ ID NO: 17329 - DNA, 23 bp, Artificial Sequence
  Synthetic construct
cgaacgttttccgaagattcggt

SEQ ID NO: 17330 - DNA, 23 bp, Artificial Sequence
  Synthetic construct
cgaacgttttgcgaagattcggt

SEQ ID NO: 17331 - DNA, 23 bp, Artificial Sequence
  Synthetic construct
cgaacgtttttcgaagattcggt

SEQ ID NO: 17332 - DNA, 23 bp, Artificial Sequence
  Synthetic construct
cgaacgttttaagaagattcggt

SEQ ID NO: 17333 - DNA, 23 bp, Artificial Sequence
  Synthetic construct
cgaacgttttaggaagattcggt

SEQ ID NO: 17334 - DNA, 23 bp, Artificial Sequence
  Synthetic construct
cgaacgttttatgaagattcggt

SEQ ID NO: 17335 - DNA, 23 bp, Artificial Sequence
  Synthetic construct
cgaacgttttacaaagattcggt

SEQ ID NO: 17336 - DNA, 23 bp, Artificial Sequence
  Synthetic construct
cgaacgttttaccaagattcggt

SEQ ID NO: 17337 - DNA, 23 bp, Artificial Sequence
  Synthetic construct
cgaacgttttactaagattcggt

SEQ ID NO: 17338 - DNA, 23 bp, Artificial Sequence
  Synthetic construct
cgaacgttttacgcagattcggt

SEQ ID NO: 17339 - DNA, 23 bp, Artificial Sequence
  Synthetic construct
cgaacgttttacggagattcggt

SEQ ID NO: 17340 - DNA, 23 bp, Artificial Sequence
  Synthetic construct
cgaacgttttacgtagattcggt

SEQ ID NO: 17341 - DNA, 23 bp, Artificial Sequence
  Synthetic construct
cgaacgttttacgacgattcggt

SEQ ID NO: 17342 - DNA, 23 bp, Artificial Sequence
  Synthetic construct
cgaacgttttacgaggattcggt

SEQ ID NO: 17343 - DNA, 23 bp, Artificial Sequence
  Synthetic construct
cgaacgttttacgatgattcggt

SEQ ID NO: 17344 - DNA, 23 bp, Artificial Sequence
  Synthetic construct
cgaacgttttacgaaaattcggt

SEQ ID NO: 17345 - DNA, 23 bp, Artificial Sequence
  Synthetic construct
cgaacgttttacgaacattcggt

SEQ ID NO: 17346 - DNA, 23 bp, Artificial Sequence
  Synthetic construct
cgaacgttttacgaatattcggt

SEQ ID NO: 17347 - DNA, 23 bp, Artificial Sequence
  Synthetic construct
cgaacgttttacgaagcttcggt

SEQ ID NO: 17348 - DNA, 23 bp, Artificial Sequence
  Synthetic construct
cgaacgttttacgaaggttcggt

SEQ ID NO: 17349 - DNA, 23 bp, Artificial Sequence
  Synthetic construct
cgaacgttttacgaagtttcggt

SEQ ID NO: 17350 - DNA, 23 bp, Artificial Sequence
  Synthetic construct
cgaacgttttacgaagaatcggt

SEQ ID NO: 17351 - DNA, 23 bp, Artificial Sequence
  Synthetic construct
cgaacgttttacgaagactcggt

SEQ ID NO: 17352 - DNA, 23 bp, Artificial Sequence
  Synthetic construct
cgaacgttttacgaagagtcggt

SEQ ID NO: 17353 - DNA, 23 bp, Artificial Sequence
  Synthetic construct
cgaacgttttacgaagatacggt

SEQ ID NO: 17354 - DNA, 23 bp, Artificial Sequence
  Synthetic construct
cgaacgttttacgaagatccggt

SEQ ID NO: 17355 - DNA, 23 bp, Artificial Sequence
  Synthetic construct
cgaacgttttacgaagatgcggt

SEQ ID NO: 17356 - DNA, 23 bp, Artificial Sequence
  Synthetic construct
cgaacgttttacgaagattaggt

SEQ ID NO: 17357 - DNA, 23 bp, Artificial Sequence
  Synthetic construct
cgaacgttttacgaagattgggt

SEQ ID NO: 17358 - DNA, 23 bp, Artificial Sequence
  Synthetic construct
cgaacgttttacgaagatttggt

SEQ ID NO: 17359 - DNA, 23 bp, Artificial Sequence
  Synthetic construct
cgaacgttttacgaagattcagt

SEQ ID NO: 17360 - DNA, 23 bp, Artificial Sequence
  Synthetic construct
cgaacgttttacgaagattccgt

SEQ ID NO: 17361 - DNA, 23 bp, Artificial Sequence
  Synthetic construct
cgaacgttttacgaagattctgt

SEQ ID NO: 17362 - DNA, 23 bp, Artificial Sequence
  Synthetic construct
cgaacgttttacgaagattcgat

SEQ ID NO: 17363 - DNA, 23 bp, Artificial Sequence
  Synthetic construct
cgaacgttttacgaagattcgct

SEQ ID NO: 17364 - DNA, 23 bp, Artificial Sequence
  Synthetic construct
cgaacgttttacgaagattcgtt

SEQ ID NO: 17365 - DNA, 23 bp, Artificial Sequence
  Synthetic construct
cgaacgttttacgaagattcgga

SEQ ID NO: 17366 - DNA, 23 bp, Artificial Sequence
  Synthetic construct
cgaacgttttacgaagattcggc

SEQ ID NO: 17367 - DNA, 23 bp, Artificial Sequence
  Synthetic construct
cgaacgttttacgaagattcggg

SEQ ID NO: 17368 - DNA, 20 bp, Artificial Sequence
  Synthetic construct
ccgaccgggagtccagttcg

SEQ ID NO: 17369 - DNA, 20 bp, Artificial Sequence
  Synthetic construct
gcgaccgggagtccagttcg

SEQ ID NO: 17370 - DNA, 20 bp, Artificial Sequence
  Synthetic construct
tcgaccgggagtccagttcg

SEQ ID NO: 17371 - DNA, 20 bp, Artificial Sequence
  Synthetic construct
aagaccgggagtccagttcg

SEQ ID NO: 17372 - DNA, 20 bp, Artificial Sequence
  Synthetic construct
aggaccgggagtccagttcg

SEQ ID NO: 17373 - DNA, 20 bp, Artificial Sequence
  Synthetic construct
atgaccgggagtccagttcg

SEQ ID NO: 17374 - DNA, 20 bp, Artificial Sequence
  Synthetic construct
acaaccgggagtccagttcg

SEQ ID NO: 17375 - DNA, 20 bp, Artificial Sequence
  Synthetic construct
accaccgggagtccagttcg

SEQ ID NO: 17376 - DNA, 20 bp, Artificial Sequence
  Synthetic construct
actaccgggagtccagttcg

SEQ ID NO: 17377 - DNA, 20 bp, Artificial Sequence
  Synthetic construct
acgcccgggagtccagttcg

SEQ ID NO: 17378 - DNA, 20 bp, Artificial Sequence
  Synthetic construct
acggccgggagtccagttcg

SEQ ID NO: 17379 - DNA, 20 bp, Artificial Sequence
  Synthetic construct
acgtccgggagtccagttcg

SEQ ID NO: 17380 - DNA, 20 bp, Artificial Sequence
  Synthetic construct
acgaacgggagtccagttcg

SEQ ID NO: 17381 - DNA, 20 bp, Artificial Sequence
  Synthetic construct
acgagcgggagtccagttcg

SEQ ID NO: 17382 - DNA, 20 bp, Artificial Sequence
  Synthetic construct
acgatcgggagtccagttcg

SEQ ID NO: 17383 - DNA, 20 bp, Artificial Sequence
  Synthetic construct
acgacagggagtccagttcg

SEQ ID NO: 17384 - DNA, 20 bp, Artificial Sequence
  Synthetic construct
acgacggggagtccagttcg

SEQ ID NO: 17385 - DNA, 20 bp, Artificial Sequence
  Synthetic construct
acgactgggagtccagttcg

SEQ ID NO: 17386 - DNA, 20 bp, Artificial Sequence
  Synthetic construct
acgaccaggagtccagttcg

SEQ ID NO: 17387 - DNA, 20 bp, Artificial Sequence
  Synthetic construct
acgacccggagtccagttcg

SEQ ID NO: 17388 - DNA, 20 bp, Artificial Sequence
  Synthetic construct
acgacctggagtccagttcg

SEQ ID NO: 17389 - DNA, 20 bp, Artificial Sequence
  Synthetic construct
acgaccgagagtccagttcg

SEQ ID NO: 17390 - DNA, 20 bp, Artificial Sequence
  Synthetic construct
acgaccgcgagtccagttcg

SEQ ID NO: 17391 - DNA, 20 bp, Artificial Sequence
  Synthetic construct
acgaccgtgagtccagttcg

SEQ ID NO: 17392 - DNA, 20 bp, Artificial Sequence
  Synthetic construct
acgaccggaagtccagttcg

SEQ ID NO: 17393 - DNA, 20 bp, Artificial Sequence
  Synthetic construct
acgaccggcagtccagttcg

SEQ ID NO: 17394 - DNA, 20 bp, Artificial Sequence
  Synthetic construct
acgaccggtagtccagttcg

SEQ ID NO: 17395 - DNA, 20 bp, Artificial Sequence
  Synthetic construct
acgaccgggcgtccagttcg

SEQ ID NO: 17396 - DNA, 20 bp, Artificial Sequence
  Synthetic construct
acgaccgggggtccagttcg

SEQ ID NO: 17397 - DNA, 20 bp, Artificial Sequence
  Synthetic construct
acgaccgggtgtccagttcg

SEQ ID NO: 17398 - DNA, 20 bp, Artificial Sequence
  Synthetic construct
acgaccgggaatccagttcg

SEQ ID NO: 17399 - DNA, 20 bp, Artificial Sequence
  Synthetic construct
acgaccgggactccagttcg

SEQ ID NO: 17400 - DNA, 20 bp, Artificial Sequence
  Synthetic construct
acgaccgggattccagttcg

SEQ ID NO: 17401 - DNA, 20 bp, Artificial Sequence
  Synthetic construct
acgaccgggagaccagttcg

SEQ ID NO: 17402 - DNA, 20 bp, Artificial Sequence
  Synthetic construct
acgaccgggagcccagttcg

SEQ ID NO: 17403 - DNA, 20 bp, Artificial Sequence
  Synthetic construct
acgaccgggaggccagttcg

SEQ ID NO: 17404 - DNA, 20 bp, Artificial Sequence
  Synthetic construct
acgaccgggagtacagttcg

SEQ ID NO: 17405 - DNA, 20 bp, Artificial Sequence
  Synthetic construct
acgaccgggagtgcagttcg

SEQ ID NO: 17406 - DNA, 20 bp, Artificial Sequence
  Synthetic construct
acgaccgggagttcagttcg

SEQ ID NO: 17407 - DNA, 20 bp, Artificial Sequence
  Synthetic construct
acgaccgggagtcaagttcg

SEQ ID NO: 17408 - DNA, 20 bp, Artificial Sequence
  Synthetic construct
acgaccgggagtcgagttcg

SEQ ID NO: 17409 - DNA, 20 bp, Artificial Sequence
  Synthetic construct
acgaccgggagtctagttcg

SEQ ID NO: 17410 - DNA, 20 bp, Artificial Sequence
  Synthetic construct
acgaccgggagtcccgttcg

SEQ ID NO: 17411 - DNA, 20 bp, Artificial Sequence
  Synthetic construct
acgaccgggagtccggttcg

SEQ ID NO: 17412 - DNA, 20 bp, Artificial Sequence
  Synthetic construct
acgaccgggagtcctgttcg

SEQ ID NO: 17413 - DNA, 20 bp, Artificial Sequence
  Synthetic construct
acgaccgggagtccaattcg

SEQ ID NO: 17414 - DNA, 20 bp, Artificial Sequence
  Synthetic construct
acgaccgggagtccacttcg

SEQ ID NO: 17415 - DNA, 20 bp, Artificial Sequence
  Synthetic construct
acgaccgggagtccatttcg

SEQ ID NO: 17416 - DNA, 20 bp, Artificial Sequence
  Synthetic construct
acgaccgggagtccagatcg

SEQ ID NO: 17417 - DNA, 20 bp, Artificial Sequence
  Synthetic construct
acgaccgggagtccagctcg

SEQ ID NO: 17418 - DNA, 20 bp, Artificial Sequence
  Synthetic construct
acgaccgggagtccaggtcg

SEQ ID NO: 17419 - DNA, 20 bp, Artificial Sequence
  Synthetic construct
acgaccgggagtccagtacg

SEQ ID NO: 17420 - DNA, 20 bp, Artificial Sequence
  Synthetic construct
acgaccgggagtccagtccg

SEQ ID NO: 17421 - DNA, 20 bp, Artificial Sequence
  Synthetic construct
acgaccgggagtccagtgcg

SEQ ID NO: 17422 - DNA, 20 bp, Artificial Sequence
  Synthetic construct
acgaccgggagtccagttag

SEQ ID NO: 17423 - DNA, 20 bp, Artificial Sequence
  Synthetic construct
acgaccgggagtccagttgg

SEQ ID NO: 17424 - DNA, 20 bp, Artificial Sequence
  Synthetic construct
acgaccgggagtccagtttg

SEQ ID NO: 17425 - DNA, 20 bp, Artificial Sequence
  Synthetic construct
acgaccgggagtccagttca

SEQ ID NO: 17426 - DNA, 20 bp, Artificial Sequence
  Synthetic construct
acgaccgggagtccagttcc

SEQ ID NO: 17427 - DNA, 20 bp, Artificial Sequence
  Synthetic construct
acgaccgggagtccagttct

SEQ ID NO: 17428 - DNA, 22 bp, Artificial Sequence
  Synthetic construct
atgggagaaaactccacaccag

SEQ ID NO: 17429 - DNA, 22 bp, Artificial Sequence
  Synthetic construct
ctgggagaaaactccacaccag

SEQ ID NO: 17430 - DNA, 22 bp, Artificial Sequence
  Synthetic construct
ttgggagaaaactccacaccag

SEQ ID NO: 17431 - DNA, 22 bp, Artificial Sequence
  Synthetic construct
gagggagaaaactccacaccag

SEQ ID NO: 17432 - DNA, 22 bp, Artificial Sequence
  Synthetic construct
gcgggagaaaactccacaccag

SEQ ID NO: 17433 - DNA, 22 bp, Artificial Sequence
  Synthetic construct
gggggagaaaactccacaccag

SEQ ID NO: 17434 - DNA, 22 bp, Artificial Sequence
  Synthetic construct
gtaggagaaaactccacaccag

SEQ ID NO: 17435 - DNA, 22 bp, Artificial Sequence
  Synthetic construct
gtcggagaaaactccacaccag

SEQ ID NO: 17436 - DNA, 22 bp, Artificial Sequence
  Synthetic construct
gttggagaaaactccacaccag

SEQ ID NO: 17437 - DNA, 22 bp, Artificial Sequence
  Synthetic construct
gtgagagaaaactccacaccag

SEQ ID NO: 17438 - DNA, 22 bp, Artificial Sequence
  Synthetic construct
gtgcgagaaaactccacaccag

SEQ ID NO: 17439 - DNA, 22 bp, Artificial Sequence
  Synthetic construct
gtgtgagaaaactccacaccag

SEQ ID NO: 17440 - DNA, 22 bp, Artificial Sequence
  Synthetic construct
gtggaagaaaactccacaccag

SEQ ID NO: 17441 - DNA, 22 bp, Artificial Sequence
  Synthetic construct
gtggcagaaaactccacaccag

SEQ ID NO: 17442 - DNA, 22 bp, Artificial Sequence
  Synthetic construct
gtggtagaaaactccacaccag

SEQ ID NO: 17443 - DNA, 22 bp, Artificial Sequence
  Synthetic construct
gtgggcgaaaactccacaccag

SEQ ID NO: 17444 - DNA, 22 bp, Artificial Sequence
  Synthetic construct
gtgggggaaaactccacaccag

SEQ ID NO: 17445 - DNA, 22 bp, Artificial Sequence
  Synthetic construct
gtgggtgaaaactccacaccag

SEQ ID NO: 17446 - DNA, 22 bp, Artificial Sequence
  Synthetic construct
gtgggaaaaaactccacaccag

SEQ ID NO: 17447 - DNA, 22 bp, Artificial Sequence
  Synthetic construct
gtgggacaaaactccacaccag

SEQ ID NO: 17448 - DNA, 22 bp, Artificial Sequence
  Synthetic construct
gtgggataaaactccacaccag

SEQ ID NO: 17449 - DNA, 22 bp, Artificial Sequence
  Synthetic construct
gtgggagcaaactccacaccag

SEQ ID NO: 17450 - DNA, 22 bp, Artificial Sequence
  Synthetic construct
gtgggaggaaactccacaccag

SEQ ID NO: 17451 - DNA, 22 bp, Artificial Sequence
  Synthetic construct
gtgggagtaaactccacaccag

SEQ ID NO: 17452 - DNA, 22 bp, Artificial Sequence
  Synthetic construct
gtgggagacaactccacaccag

SEQ ID NO: 17453 - DNA, 22 bp, Artificial Sequence
  Synthetic construct
gtgggagagaactccacaccag

SEQ ID NO: 17454 - DNA, 22 bp, Artificial Sequence
  Synthetic construct
gtgggagataactccacaccag

SEQ ID NO: 17455 - DNA, 22 bp, Artificial Sequence
  Synthetic construct
gtgggagaacactccacaccag

SEQ ID NO: 17456 - DNA, 22 bp, Artificial Sequence
  Synthetic construct
gtgggagaagactccacaccag

SEQ ID NO: 17457 - DNA, 22 bp, Artificial Sequence
  Synthetic construct
gtgggagaatactccacaccag

SEQ ID NO: 17458 - DNA, 22 bp, Artificial Sequence
  Synthetic construct
gtgggagaaacctccacaccag

SEQ ID NO: 17459 - DNA, 22 bp, Artificial Sequence
  Synthetic construct
gtgggagaaagctccacaccag

SEQ ID NO: 17460 - DNA, 22 bp, Artificial Sequence
  Synthetic construct
gtgggagaaatctccacaccag

SEQ ID NO: 17461 - DNA, 22 bp, Artificial Sequence
  Synthetic construct
gtgggagaaaaatccacaccag

SEQ ID NO: 17462 - DNA, 22 bp, Artificial Sequence
  Synthetic construct
gtgggagaaaagtccacaccag

SEQ ID NO: 17463 - DNA, 22 bp, Artificial Sequence
  Synthetic construct
gtgggagaaaattccacaccag

SEQ ID NO: 17464 - DNA, 22 bp, Artificial Sequence
  Synthetic construct
gtgggagaaaacaccacaccag

SEQ ID NO: 17465 - DNA, 22 bp, Artificial Sequence
  Synthetic construct
gtgggagaaaaccccacaccag

SEQ ID NO: 17466 - DNA, 22 bp, Artificial Sequence
  Synthetic construct
gtgggagaaaacgccacaccag

SEQ ID NO: 17467 - DNA, 22 bp, Artificial Sequence
  Synthetic construct
gtgggagaaaactacacaccag

SEQ ID NO: 17468 - DNA, 22 bp, Artificial Sequence
  Synthetic construct
gtgggagaaaactgcacaccag

SEQ ID NO: 17469 - DNA, 22 bp, Artificial Sequence
  Synthetic construct
gtgggagaaaacttcacaccag

SEQ ID NO: 17470 - DNA, 22 bp, Artificial Sequence
  Synthetic construct
gtgggagaaaactcaacaccag

SEQ ID NO: 17471 - DNA, 22 bp, Artificial Sequence
  Synthetic construct
gtgggagaaaactcgacaccag

SEQ ID NO: 17472 - DNA, 22 bp, Artificial Sequence
  Synthetic construct
gtgggagaaaactctacaccag

SEQ ID NO: 17473 - DNA, 22 bp, Artificial Sequence
  Synthetic construct
gtgggagaaaactccccaccag

SEQ ID NO: 17474 - DNA, 22 bp, Artificial Sequence
  Synthetic construct
gtgggagaaaactccgcaccag

SEQ ID NO: 17475 - DNA, 22 bp, Artificial Sequence
  Synthetic construct
gtgggagaaaactcctcaccag

SEQ ID NO: 17476 - DNA, 22 bp, Artificial Sequence
  Synthetic construct
gtgggagaaaactccaaaccag

SEQ ID NO: 17477 - DNA, 22 bp, Artificial Sequence
  Synthetic construct
gtgggagaaaactccagaccag

SEQ ID NO: 17478 - DNA, 22 bp, Artificial Sequence
  Synthetic construct
gtgggagaaaactccataccag

SEQ ID NO: 17479 - DNA, 22 bp, Artificial Sequence
  Synthetic construct
gtgggagaaaactccaccccag

SEQ ID NO: 17480 - DNA, 22 bp, Artificial Sequence
  Synthetic construct
gtgggagaaaactccacgccag

SEQ ID NO: 17481 - DNA, 22 bp, Artificial Sequence
  Synthetic construct
gtgggagaaaactccactccag

SEQ ID NO: 17482 - DNA, 22 bp, Artificial Sequence
  Synthetic construct
gtgggagaaaactccacaacag

SEQ ID NO: 17483 - DNA, 22 bp, Artificial Sequence
  Synthetic construct
gtgggagaaaactccacagcag

SEQ ID NO: 17484 - DNA, 22 bp, Artificial Sequence
  Synthetic construct
gtgggagaaaactccacatcag

SEQ ID NO: 17485 - DNA, 22 bp, Artificial Sequence
  Synthetic construct
gtgggagaaaactccacacaag

SEQ ID NO: 17486 - DNA, 22 bp, Artificial Sequence
  Synthetic construct
gtgggagaaaactccacacgag

SEQ ID NO: 17487 - DNA, 22 bp, Artificial Sequence
  Synthetic construct
gtgggagaaaactccacactag

SEQ ID NO: 17488 - DNA, 22 bp, Artificial Sequence
  Synthetic construct
gtgggagaaaactccacacccg

SEQ ID NO: 17489 - DNA, 22 bp, Artificial Sequence
  Synthetic construct
gtgggagaaaactccacaccgg

SEQ ID NO: 17490 - DNA, 22 bp, Artificial Sequence
  Synthetic construct
gtgggagaaaactccacacctg

SEQ ID NO: 17491 - DNA, 22 bp, Artificial Sequence
  Synthetic construct
gtgggagaaaactccacaccaa

SEQ ID NO: 17492 - DNA, 22 bp, Artificial Sequence
  Synthetic construct
gtgggagaaaactccacaccac

SEQ ID NO: 17493 - DNA, 22 bp, Artificial Sequence
  Synthetic construct
gtgggagaaaactccacaccat

SEQ ID NO: 17494 - DNA, 21 bp, Artificial Sequence
  Synthetic construct
acttccagtagcgacagaagc

SEQ ID NO: 17495 - DNA, 21 bp, Artificial Sequence
  Synthetic construct
ccttccagtagcgacagaagc

SEQ ID NO: 17496 - DNA, 21 bp, Artificial Sequence
  Synthetic construct
tcttccagtagcgacagaagc

SEQ ID NO: 17497 - DNA, 21 bp, Artificial Sequence
  Synthetic construct
gattccagtagcgacagaagc

SEQ ID NO: 17498 - DNA, 21 bp, Artificial Sequence
  Synthetic construct
ggttccagtagcgacagaagc

SEQ ID NO: 17499 - DNA, 21 bp, Artificial Sequence
  Synthetic construct
gtttccagtagcgacagaagc

SEQ ID NO: 17500 - DNA, 21 bp, Artificial Sequence
  Synthetic construct
gcatccagtagcgacagaagc

SEQ ID NO: 17501 - DNA, 21 bp, Artificial Sequence
  Synthetic construct
gcctccagtagcgacagaagc

SEQ ID NO: 17502 - DNA, 21 bp, Artificial Sequence
  Synthetic construct
gcgtccagtagcgacagaagc

SEQ ID NO: 17503 - DNA, 21 bp, Artificial Sequence
  Synthetic construct
gctaccagtagcgacagaagc

SEQ ID NO: 17504 - DNA, 21 bp, Artificial Sequence
  Synthetic construct
gctcccagtagcgacagaagc

SEQ ID NO: 17505 - DNA, 21 bp, Artificial Sequence
  Synthetic construct
gctgccagtagcgacagaagc

SEQ ID NO: 17506 - DNA, 21 bp, Artificial Sequence
  Synthetic construct
gcttacagtagcgacagaagc

SEQ ID NO: 17507 - DNA, 21 bp, Artificial Sequence
  Synthetic construct
gcttgcagtagcgacagaagc

SEQ ID NO: 17508 - DNA, 21 bp, Artificial Sequence
  Synthetic construct
gctttcagtagcgacagaagc

SEQ ID NO: 17509 - DNA, 21 bp, Artificial Sequence
  Synthetic construct
gcttcaagtagcgacagaagc

SEQ ID NO: 17510 - DNA, 21 bp, Artificial Sequence
  Synthetic construct
gcttcgagtagcgacagaagc

SEQ ID NO: 17511 - DNA, 21 bp, Artificial Sequence
  Synthetic construct
gcttctagtagcgacagaagc

SEQ ID NO: 17512 - DNA, 21 bp, Artificial Sequence
  Synthetic construct
gcttcccgtagcgacagaagc

SEQ ID NO: 17513 - DNA, 21 bp, Artificial Sequence
  Synthetic construct
gcttccggtagcgacagaagc

SEQ ID NO: 17514 - DNA, 21 bp, Artificial Sequence
  Synthetic construct
gcttcctgtagcgacagaagc

SEQ ID NO: 17515 - DNA, 21 bp, Artificial Sequence
  Synthetic construct
gcttccaatagcgacagaagc

SEQ ID NO: 17516 - DNA, 21 bp, Artificial Sequence
  Synthetic construct
gcttccactagcgacagaagc

SEQ ID NO: 17517 - DNA, 21 bp, Artificial Sequence
  Synthetic construct
gcttccattagcgacagaagc

SEQ ID NO: 17518 - DNA, 21 bp, Artificial Sequence
  Synthetic construct
gcttccagaagcgacagaagc

SEQ ID NO: 17519 - DNA, 21 bp, Artificial Sequence
  Synthetic construct
gcttccagcagcgacagaagc

SEQ ID NO: 17520 - DNA, 21 bp, Artificial Sequence
  Synthetic construct
gcttccaggagcgacagaagc

SEQ ID NO: 17521 - DNA, 21 bp, Artificial Sequence
  Synthetic construct
gcttccagtcgcgacagaagc

SEQ ID NO: 17522 - DNA, 21 bp, Artificial Sequence
  Synthetic construct
gcttccagtggcgacagaagc

SEQ ID NO: 17523 - DNA, 21 bp, Artificial Sequence
  Synthetic construct
gcttccagttgcgacagaagc

SEQ ID NO: 17524 - DNA, 21 bp, Artificial Sequence
  Synthetic construct
gcttccagtaacgacagaagc

SEQ ID NO: 17525 - DNA, 21 bp, Artificial Sequence
  Synthetic construct
gcttccagtaccgacagaagc

SEQ ID NO: 17526 - DNA, 21 bp, Artificial Sequence
  Synthetic construct
gcttccagtatcgacagaagc

SEQ ID NO: 17527 - DNA, 21 bp, Artificial Sequence
  Synthetic construct
gcttccagtagagacagaagc

SEQ ID NO: 17528 - DNA, 21 bp, Artificial Sequence
  Synthetic construct
gcttccagtagggacagaagc

SEQ ID NO: 17529 - DNA, 21 bp, Artificial Sequence
  Synthetic construct
gcttccagtagtgacagaagc

SEQ ID NO: 17530 - DNA, 21 bp, Artificial Sequence
  Synthetic construct
gcttccagtagcaacagaagc

SEQ ID NO: 17531 - DNA, 21 bp, Artificial Sequence
  Synthetic construct
gcttccagtagccacagaagc

SEQ ID NO: 17532 - DNA, 21 bp, Artificial Sequence
  Synthetic construct
gcttccagtagctacagaagc

SEQ ID NO: 17533 - DNA, 21 bp, Artificial Sequence
  Synthetic construct
gcttccagtagcgccagaagc

SEQ ID NO: 17534 - DNA, 21 bp, Artificial Sequence
  Synthetic construct
gcttccagtagcggcagaagc

SEQ ID NO: 17535 - DNA, 21 bp, Artificial Sequence
  Synthetic construct
gcttccagtagcgtcagaagc

SEQ ID NO: 17536 - DNA, 21 bp, Artificial Sequence
  Synthetic construct
gcttccagtagcgaaagaagc

SEQ ID NO: 17537 - DNA, 21 bp, Artificial Sequence
  Synthetic construct
gcttccagtagcgagagaagc

SEQ ID NO: 17538 - DNA, 21 bp, Artificial Sequence
  Synthetic construct
gcttccagtagcgatagaagc

SEQ ID NO: 17539 - DNA, 21 bp, Artificial Sequence
  Synthetic construct
gcttccagtagcgaccgaagc

SEQ ID NO: 17540 - DNA, 21 bp, Artificial Sequence
  Synthetic construct
gcttccagtagcgacggaagc

SEQ ID NO: 17541 - DNA, 21 bp, Artificial Sequence
  Synthetic construct
gcttccagtagcgactgaagc

SEQ ID NO: 17542 - DNA, 21 bp, Artificial Sequence
  Synthetic construct
gcttccagtagcgacaaaagc

SEQ ID NO: 17543 - DNA, 21 bp, Artificial Sequence
  Synthetic construct
gcttccagtagcgacacaagc

SEQ ID NO: 17544 - DNA, 21 bp, Artificial Sequence
  Synthetic construct
gcttccagtagcgacataagc

SEQ ID NO: 17545 - DNA, 21 bp, Artificial Sequence
  Synthetic construct
gcttccagtagcgacagcagc

SEQ ID NO: 17546 - DNA, 21 bp, Artificial Sequence
  Synthetic construct
gcttccagtagcgacaggagc

SEQ ID NO: 17547 - DNA, 21 bp, Artificial Sequence
  Synthetic construct
gcttccagtagcgacagtagc

SEQ ID NO: 17548 - DNA, 21 bp, Artificial Sequence
  Synthetic construct
gcttccagtagcgacagacgc

SEQ ID NO: 17549 - DNA, 21 bp, Artificial Sequence
  Synthetic construct
gcttccagtagcgacagaggc

SEQ ID NO: 17550 - DNA, 21 bp, Artificial Sequence
  Synthetic construct
gcttccagtagcgacagatgc

SEQ ID NO: 17551 - DNA, 21 bp, Artificial Sequence
  Synthetic construct
gcttccagtagcgacagaaac

SEQ ID NO: 17552 - DNA, 21 bp, Artificial Sequence
  Synthetic construct
gcttccagtagcgacagaacc

SEQ ID NO: 17553 - DNA, 21 bp, Artificial Sequence
  Synthetic construct
gcttccagtagcgacagaatc

SEQ ID NO: 17554 - DNA, 21 bp, Artificial Sequence
  Synthetic construct
gcttccagtagcgacagaaga

SEQ ID NO: 17555 - DNA, 21 bp, Artificial Sequence
  Synthetic construct
gcttccagtagcgacagaagg

SEQ ID NO: 17556 - DNA, 21 bp, Artificial Sequence
  Synthetic construct
gcttccagtagcgacagaagt

SEQ ID NO: 17557 - DNA, 22 bp, Artificial Sequence
  Synthetic construct
cacagtctgggttgccacttta

SEQ ID NO: 17558 - DNA, 22 bp, Artificial Sequence
  Synthetic construct
gacagtctgggttgccacttta

SEQ ID NO: 17559 - DNA, 22 bp, Artificial Sequence
  Synthetic construct
tacagtctgggttgccacttta

SEQ ID NO: 17560 - DNA, 22 bp, Artificial Sequence
  Synthetic construct
accagtctgggttgccacttta

SEQ ID NO: 17561 - DNA, 22 bp, Artificial Sequence
  Synthetic construct
agcagtctgggttgccacttta

SEQ ID NO: 17562 - DNA, 22 bp, Artificial Sequence
  Synthetic construct
atcagtctgggttgccacttta

SEQ ID NO: 17563 - DNA, 22 bp, Artificial Sequence
  Synthetic construct
aaaagtctgggttgccacttta

SEQ ID NO: 17564 - DNA, 22 bp, Artificial Sequence
  Synthetic construct
aagagtctgggttgccacttta

SEQ ID NO: 17565 - DNA, 22 bp, Artificial Sequence
  Synthetic construct
aatagtctgggttgccacttta

SEQ ID NO: 17566 - DNA, 22 bp, Artificial Sequence
  Synthetic construct
aaccgtctgggttgccacttta

SEQ ID NO: 17567 - DNA, 22 bp, Artificial Sequence
  Synthetic construct
aacggtctgggttgccacttta

SEQ ID NO: 17568 - DNA, 22 bp, Artificial Sequence
  Synthetic construct
aactgtctgggttgccacttta

SEQ ID NO: 17569 - DNA, 22 bp, Artificial Sequence
  Synthetic construct
aacaatctgggttgccacttta

SEQ ID NO: 17570 - DNA, 22 bp, Artificial Sequence
  Synthetic construct
aacactctgggttgccacttta

SEQ ID NO: 17571 - DNA, 22 bp, Artificial Sequence
  Synthetic construct
aacattctgggttgccacttta

SEQ ID NO: 17572 - DNA, 22 bp, Artificial Sequence
  Synthetic construct
aacagactgggttgccacttta

SEQ ID NO: 17573 - DNA, 22 bp, Artificial Sequence
  Synthetic construct
aacagcctgggttgccacttta

SEQ ID NO: 17574 - DNA, 22 bp, Artificial Sequence
  Synthetic construct
aacaggctgggttgccacttta

SEQ ID NO: 17575 - DNA, 22 bp, Artificial Sequence
  Synthetic construct
aacagtatgggttgccacttta

SEQ ID NO: 17576 - DNA, 22 bp, Artificial Sequence
  Synthetic construct
aacagtgtgggttgccacttta

SEQ ID NO: 17577 - DNA, 22 bp, Artificial Sequence
  Synthetic construct
aacagtttgggttgccacttta

SEQ ID NO: 17578 - DNA, 22 bp, Artificial Sequence
  Synthetic construct
aacagtcagggttgccacttta

SEQ ID NO: 17579 - DNA, 22 bp, Artificial Sequence
  Synthetic construct
aacagtccgggttgccacttta

SEQ ID NO: 17580 - DNA, 22 bp, Artificial Sequence
  Synthetic construct
aacagtcggggttgccacttta

SEQ ID NO: 17581 - DNA, 22 bp, Artificial Sequence
  Synthetic construct
aacagtctaggttgccacttta

SEQ ID NO: 17582 - DNA, 22 bp, Artificial Sequence
  Synthetic construct
aacagtctcggttgccacttta

SEQ ID NO: 17583 - DNA, 22 bp, Artificial Sequence
  Synthetic construct
aacagtcttggttgccacttta

SEQ ID NO: 17584 - DNA, 22 bp, Artificial Sequence
  Synthetic construct
aacagtctgagttgccacttta

SEQ ID NO: 17585 - DNA, 22 bp, Artificial Sequence
  Synthetic construct
aacagtctgcgttgccacttta

SEQ ID NO: 17586 - DNA, 22 bp, Artificial Sequence
  Synthetic construct
aacagtctgtgttgccacttta

SEQ ID NO: 17587 - DNA, 22 bp, Artificial Sequence
  Synthetic construct
aacagtctggattgccacttta

SEQ ID NO: 17588 - DNA, 22 bp, Artificial Sequence
  Synthetic construct
aacagtctggcttgccacttta

SEQ ID NO: 17589 - DNA, 22 bp, Artificial Sequence
  Synthetic construct
aacagtctggtttgccacttta

SEQ ID NO: 17590 - DNA, 22 bp, Artificial Sequence
  Synthetic construct
aacagtctgggatgccacttta

SEQ ID NO: 17591 - DNA, 22 bp, Artificial Sequence
  Synthetic construct
aacagtctgggctgccacttta

SEQ ID NO: 17592 - DNA, 22 bp, Artificial Sequence
  Synthetic construct
aacagtctggggtgccacttta

SEQ ID NO: 17593 - DNA, 22 bp, Artificial Sequence
  Synthetic construct
aacagtctgggtagccacttta

SEQ ID NO: 17594 - DNA, 22 bp, Artificial Sequence
  Synthetic construct
aacagtctgggtcgccacttta

SEQ ID NO: 17595 - DNA, 22 bp, Artificial Sequence
  Synthetic construct
aacagtctgggtggccacttta

SEQ ID NO: 17596 - DNA, 22 bp, Artificial Sequence
  Synthetic construct
aacagtctgggttaccacttta

SEQ ID NO: 17597 - DNA, 22 bp, Artificial Sequence
  Synthetic construct
aacagtctgggttcccacttta

SEQ ID NO: 17598 - DNA, 22 bp, Artificial Sequence
  Synthetic construct
aacagtctgggtttccacttta

SEQ ID NO: 17599 - DNA, 22 bp, Artificial Sequence
  Synthetic construct
aacagtctgggttgacacttta

SEQ ID NO: 17600 - DNA, 22 bp, Artificial Sequence
  Synthetic construct
aacagtctgggttggcacttta

SEQ ID NO: 17601 - DNA, 22 bp, Artificial Sequence
  Synthetic construct
aacagtctgggttgtcacttta

SEQ ID NO: 17602 - DNA, 22 bp, Artificial Sequence
  Synthetic construct
aacagtctgggttgcaacttta

SEQ ID NO: 17603 - DNA, 22 bp, Artificial Sequence
  Synthetic construct
aacagtctgggttgcgacttta

SEQ ID NO: 17604 - DNA, 22 bp, Artificial Sequence
  Synthetic construct
aacagtctgggttgctacttta

SEQ ID NO: 17605 - DNA, 22 bp, Artificial Sequence
  Synthetic construct
aacagtctgggttgccccttta

SEQ ID NO: 17606 - DNA, 22 bp, Artificial Sequence
  Synthetic construct
aacagtctgggttgccgcttta

SEQ ID NO: 17607 - DNA, 22 bp, Artificial Sequence
  Synthetic construct
aacagtctgggttgcctcttta

SEQ ID NO: 17608 - DNA, 22 bp, Artificial Sequence
  Synthetic construct
aacagtctgggttgccaattta

SEQ ID NO: 17609 - DNA, 22 bp, Artificial Sequence
  Synthetic construct
aacagtctgggttgccagttta

SEQ ID NO: 17610 - DNA, 22 bp, Artificial Sequence
  Synthetic construct
aacagtctgggttgccatttta

SEQ ID NO: 17611 - DNA, 22 bp, Artificial Sequence
  Synthetic construct
aacagtctgggttgccacatta

SEQ ID NO: 17612 - DNA, 22 bp, Artificial Sequence
  Synthetic construct
aacagtctgggttgccacctta

SEQ ID NO: 17613 - DNA, 22 bp, Artificial Sequence
  Synthetic construct
aacagtctgggttgccacgtta

SEQ ID NO: 17614 - DNA, 22 bp, Artificial Sequence
  Synthetic construct
aacagtctgggttgccactata

SEQ ID NO: 17615 - DNA, 22 bp, Artificial Sequence
  Synthetic construct
aacagtctgggttgccactcta

SEQ ID NO: 17616 - DNA, 22 bp, Artificial Sequence
  Synthetic construct
aacagtctgggttgccactgta

SEQ ID NO: 17617 - DNA, 22 bp, Artificial Sequence
  Synthetic construct
aacagtctgggttgccacttaa

SEQ ID NO: 17618 - DNA, 22 bp, Artificial Sequence
  Synthetic construct
aacagtctgggttgccacttca

SEQ ID NO: 17619 - DNA, 22 bp, Artificial Sequence
  Synthetic construct
aacagtctgggttgccacttga

SEQ ID NO: 17620 - DNA, 22 bp, Artificial Sequence
  Synthetic construct
aacagtctgggttgccactttc

SEQ ID NO: 17621 - DNA, 22 bp, Artificial Sequence
  Synthetic construct
aacagtctgggttgccactttg

SEQ ID NO: 17622 - DNA, 22 bp, Artificial Sequence
  Synthetic construct
aacagtctgggttgccactttt

SEQ ID NO: 17623 - DNA, 20 bp, Artificial Sequence
  Synthetic construct
cgagaaagatcgcgaggaag

SEQ ID NO: 17624 - DNA, 20 bp, Artificial Sequence
  Synthetic construct
ggagaaagatcgcgaggaag

SEQ ID NO: 17625 - DNA, 20 bp, Artificial Sequence
  Synthetic construct
tgagaaagatcgcgaggaag

SEQ ID NO: 17626 - DNA, 20 bp, Artificial Sequence
  Synthetic construct
aaagaaagatcgcgaggaag

SEQ ID NO: 17627 - DNA, 20 bp, Artificial Sequence
  Synthetic construct
acagaaagatcgcgaggaag

SEQ ID NO: 17628 - DNA, 20 bp, Artificial Sequence
  Synthetic construct
atagaaagatcgcgaggaag

SEQ ID NO: 17629 - DNA, 20 bp, Artificial Sequence
  Synthetic construct
agcgaaagatcgcgaggaag

SEQ ID NO: 17630 - DNA, 20 bp, Artificial Sequence
  Synthetic construct
agggaaagatcgcgaggaag

SEQ ID NO: 17631 - DNA, 20 bp, Artificial Sequence
  Synthetic construct
agtgaaagatcgcgaggaag

SEQ ID NO: 17632 - DNA, 20 bp, Artificial Sequence
  Synthetic construct
agaaaaagatcgcgaggaag

SEQ ID NO: 17633 - DNA, 20 bp, Artificial Sequence
  Synthetic construct
agacaaagatcgcgaggaag

SEQ ID NO: 17634 - DNA, 20 bp, Artificial Sequence
  Synthetic construct
agataaagatcgcgaggaag

SEQ ID NO: 17635 - DNA, 20 bp, Artificial Sequence
  Synthetic construct
agagcaagatcgcgaggaag

SEQ ID NO: 17636 - DNA, 20 bp, Artificial Sequence
  Synthetic construct
agaggaagatcgcgaggaag

SEQ ID NO: 17637 - DNA, 20 bp, Artificial Sequence
  Synthetic construct
agagtaagatcgcgaggaag

SEQ ID NO: 17638 - DNA, 20 bp, Artificial Sequence
  Synthetic construct
agagacagatcgcgaggaag

SEQ ID NO: 17639 - DNA, 20 bp, Artificial Sequence
  Synthetic construct
agagagagatcgcgaggaag

SEQ ID NO: 17640 - DNA, 20 bp, Artificial Sequence
  Synthetic construct
agagatagatcgcgaggaag

SEQ ID NO: 17641 - DNA, 20 bp, Artificial Sequence
  Synthetic construct
agagaacgatcgcgaggaag

SEQ ID NO: 17642 - DNA, 20 bp, Artificial Sequence
  Synthetic construct
agagaaggatcgcgaggaag

SEQ ID NO: 17643 - DNA, 20 bp, Artificial Sequence
  Synthetic construct
agagaatgatcgcgaggaag

SEQ ID NO: 17644 - DNA, 20 bp, Artificial Sequence
  Synthetic construct
agagaaaaatcgcgaggaag

SEQ ID NO: 17645 - DNA, 20 bp, Artificial Sequence
  Synthetic construct
agagaaacatcgcgaggaag

SEQ ID NO: 17646 - DNA, 20 bp, Artificial Sequence
  Synthetic construct
agagaaatatcgcgaggaag

SEQ ID NO: 17647 - DNA, 20 bp, Artificial Sequence
  Synthetic construct
agagaaagctcgcgaggaag

SEQ ID NO: 17648 - DNA, 20 bp, Artificial Sequence
  Synthetic construct
agagaaaggtcgcgaggaag

SEQ ID NO: 17649 - DNA, 20 bp, Artificial Sequence
  Synthetic construct
agagaaagttcgcgaggaag

SEQ ID NO: 17650 - DNA, 20 bp, Artificial Sequence
  Synthetic construct
agagaaagaacgcgaggaag

SEQ ID NO: 17651 - DNA, 20 bp, Artificial Sequence
  Synthetic construct
agagaaagaccgcgaggaag

SEQ ID NO: 17652 - DNA, 20 bp, Artificial Sequence
  Synthetic construct
agagaaagagcgcgaggaag

SEQ ID NO: 17653 - DNA, 20 bp, Artificial Sequence
  Synthetic construct
agagaaagatagcgaggaag

SEQ ID NO: 17654 - DNA, 20 bp, Artificial Sequence
  Synthetic construct
agagaaagatggcgaggaag

SEQ ID NO: 17655 - DNA, 20 bp, Artificial Sequence
  Synthetic construct
agagaaagattgcgaggaag

SEQ ID NO: 17656 - DNA, 20 bp, Artificial Sequence
  Synthetic construct
agagaaagatcacgaggaag

SEQ ID NO: 17657 - DNA, 20 bp, Artificial Sequence
  Synthetic construct
agagaaagatcccgaggaag

SEQ ID NO: 17658 - DNA, 20 bp, Artificial Sequence
  Synthetic construct
agagaaagatctcgaggaag

SEQ ID NO: 17659 - DNA, 20 bp, Artificial Sequence
  Synthetic construct
agagaaagatcgagaggaag

SEQ ID NO: 17660 - DNA, 20 bp, Artificial Sequence
  Synthetic construct
agagaaagatcgggaggaag

SEQ ID NO: 17661 - DNA, 20 bp, Artificial Sequence
  Synthetic construct
agagaaagatcgtgaggaag

SEQ ID NO: 17662 - DNA, 20 bp, Artificial Sequence
  Synthetic construct
agagaaagatcgcaaggaag

SEQ ID NO: 17663 - DNA, 20 bp, Artificial Sequence
  Synthetic construct
agagaaagatcgccaggaag

SEQ ID NO: 17664 - DNA, 20 bp, Artificial Sequence
  Synthetic construct
agagaaagatcgctaggaag

SEQ ID NO: 17665 - DNA, 20 bp, Artificial Sequence
  Synthetic construct
agagaaagatcgcgcggaag

SEQ ID NO: 17666 - DNA, 20 bp, Artificial Sequence
  Synthetic construct
agagaaagatcgcggggaag

SEQ ID NO: 17667 - DNA, 20 bp, Artificial Sequence
  Synthetic construct
agagaaagatcgcgtggaag

SEQ ID NO: 17668 - DNA, 20 bp, Artificial Sequence
  Synthetic construct
agagaaagatcgcgaagaag

SEQ ID NO: 17669 - DNA, 20 bp, Artificial Sequence
  Synthetic construct
agagaaagatcgcgacgaag

SEQ ID NO: 17670 - DNA, 20 bp, Artificial Sequence
  Synthetic construct
agagaaagatcgcgatgaag

SEQ ID NO: 17671 - DNA, 20 bp, Artificial Sequence
  Synthetic construct
agagaaagatcgcgagaaag

SEQ ID NO: 17672 - DNA, 20 bp, Artificial Sequence
  Synthetic construct
agagaaagatcgcgagcaag

SEQ ID NO: 17673 - DNA, 20 bp, Artificial Sequence
  Synthetic construct
agagaaagatcgcgagtaag

SEQ ID NO: 17674 - DNA, 20 bp, Artificial Sequence
  Synthetic construct
agagaaagatcgcgaggcag

SEQ ID NO: 17675 - DNA, 20 bp, Artificial Sequence
  Synthetic construct
agagaaagatcgcgagggag

SEQ ID NO: 17676 - DNA, 20 bp, Artificial Sequence
  Synthetic construct
agagaaagatcgcgaggtag

SEQ ID NO: 17677 - DNA, 20 bp, Artificial Sequence
  Synthetic construct
agagaaagatcgcgaggacg

SEQ ID NO: 17678 - DNA, 20 bp, Artificial Sequence
  Synthetic construct
agagaaagatcgcgaggagg

SEQ ID NO: 17679 - DNA, 20 bp, Artificial Sequence
  Synthetic construct
agagaaagatcgcgaggatg

SEQ ID NO: 17680 - DNA, 20 bp, Artificial Sequence
  Synthetic construct
agagaaagatcgcgaggaaa

SEQ ID NO: 17681 - DNA, 20 bp, Artificial Sequence
  Synthetic construct
agagaaagatcgcgaggaac

SEQ ID NO: 17682 - DNA, 20 bp, Artificial Sequence
  Synthetic construct
agagaaagatcgcgaggaat

SEQ ID NO: 17683 - DNA, 20 bp, Artificial Sequence
  Synthetic construct
atagggagcgtcaacgctta

SEQ ID NO: 17684 - DNA, 20 bp, Artificial Sequence
  Synthetic construct
ctagggagcgtcaacgctta

SEQ ID NO: 17685 - DNA, 20 bp, Artificial Sequence
  Synthetic construct
ttagggagcgtcaacgctta

SEQ ID NO: 17686 - DNA, 20 bp, Artificial Sequence
  Synthetic construct
gaagggagcgtcaacgctta

SEQ ID NO: 17687 - DNA, 20 bp, Artificial Sequence
  Synthetic construct
gcagggagcgtcaacgctta

SEQ ID NO: 17688 - DNA, 20 bp, Artificial Sequence
  Synthetic construct
ggagggagcgtcaacgctta

SEQ ID NO: 17689 - DNA, 20 bp, Artificial Sequence
  Synthetic construct
gtcgggagcgtcaacgctta

SEQ ID NO: 17690 - DNA, 20 bp, Artificial Sequence
  Synthetic construct
gtggggagcgtcaacgctta

SEQ ID NO: 17691 - DNA, 20 bp, Artificial Sequence
  Synthetic construct
gttgggagcgtcaacgctta

SEQ ID NO: 17692 - DNA, 20 bp, Artificial Sequence
  Synthetic construct
gtaaggagcgtcaacgctta

SEQ ID NO: 17693 - DNA, 20 bp, Artificial Sequence
  Synthetic construct
gtacggagcgtcaacgctta

SEQ ID NO: 17694 - DNA, 20 bp, Artificial Sequence
  Synthetic construct
gtatggagcgtcaacgctta

SEQ ID NO: 17695 - DNA, 20 bp, Artificial Sequence
  Synthetic construct
gtagagagcgtcaacgctta

SEQ ID NO: 17696 - DNA, 20 bp, Artificial Sequence
  Synthetic construct
gtagcgagcgtcaacgctta

SEQ ID NO: 17697 - DNA, 20 bp, Artificial Sequence
  Synthetic construct
gtagtgagcgtcaacgctta

SEQ ID NO: 17698 - DNA, 20 bp, Artificial Sequence
  Synthetic construct
gtaggaagcgtcaacgctta

SEQ ID NO: 17699 - DNA, 20 bp, Artificial Sequence
  Synthetic construct
gtaggcagcgtcaacgctta

SEQ ID NO: 17700 - DNA, 20 bp, Artificial Sequence
  Synthetic construct
gtaggtagcgtcaacgctta

SEQ ID NO: 17701 - DNA, 20 bp, Artificial Sequence
  Synthetic construct
gtagggcgcgtcaacgctta

SEQ ID NO: 17702 - DNA, 20 bp, Artificial Sequence
  Synthetic construct
gtagggggcgtcaacgctta

SEQ ID NO: 17703 - DNA, 20 bp, Artificial Sequence
  Synthetic construct
gtagggtgcgtcaacgctta

SEQ ID NO: 17704 - DNA, 20 bp, Artificial Sequence
  Synthetic construct
gtagggaacgtcaacgctta

SEQ ID NO: 17705 - DNA, 20 bp, Artificial Sequence
  Synthetic construct
gtagggaccgtcaacgctta

SEQ ID NO: 17706 - DNA, 20 bp, Artificial Sequence
  Synthetic construct
gtagggatcgtcaacgctta

SEQ ID NO: 17707 - DNA, 20 bp, Artificial Sequence
  Synthetic construct
gtagggagagtcaacgctta

SEQ ID NO: 17708 - DNA, 20 bp, Artificial Sequence
  Synthetic construct
gtagggagggtcaacgctta

SEQ ID NO: 17709 - DNA, 20 bp, Artificial Sequence
  Synthetic construct
gtagggagtgtcaacgctta

SEQ ID NO: 17710 - DNA, 20 bp, Artificial Sequence
  Synthetic construct
gtagggagcatcaacgctta

SEQ ID NO: 17711 - DNA, 20 bp, Artificial Sequence
  Synthetic construct
gtagggagcctcaacgctta

SEQ ID NO: 17712 - DNA, 20 bp, Artificial Sequence
  Synthetic construct
gtagggagcttcaacgctta

SEQ ID NO: 17713 - DNA, 20 bp, Artificial Sequence
  Synthetic construct
gtagggagcgacaacgctta

SEQ ID NO: 17714 - DNA, 20 bp, Artificial Sequence
  Synthetic construct
gtagggagcgccaacgctta

SEQ ID NO: 17715 - DNA, 20 bp, Artificial Sequence
  Synthetic construct
gtagggagcggcaacgctta

SEQ ID NO: 17716 - DNA, 20 bp, Artificial Sequence
  Synthetic construct
gtagggagcgtaaacgctta

SEQ ID NO: 17717 - DNA, 20 bp, Artificial Sequence
  Synthetic construct
gtagggagcgtgaacgctta

SEQ ID NO: 17718 - DNA, 20 bp, Artificial Sequence
  Synthetic construct
gtagggagcgttaacgctta

SEQ ID NO: 17719 - DNA, 20 bp, Artificial Sequence
  Synthetic construct
gtagggagcgtccacgctta

SEQ ID NO: 17720 - DNA, 20 bp, Artificial Sequence
  Synthetic construct
gtagggagcgtcgacgctta

SEQ ID NO: 17721 - DNA, 20 bp, Artificial Sequence
  Synthetic construct
gtagggagcgtctacgctta

SEQ ID NO: 17722 - DNA, 20 bp, Artificial Sequence
  Synthetic construct
gtagggagcgtcaccgctta

SEQ ID NO: 17723 - DNA, 20 bp, Artificial Sequence
  Synthetic construct
gtagggagcgtcagcgctta

SEQ ID NO: 17724 - DNA, 20 bp, Artificial Sequence
  Synthetic construct
gtagggagcgtcatcgctta

SEQ ID NO: 17725 - DNA, 20 bp, Artificial Sequence
  Synthetic construct
gtagggagcgtcaaagctta

SEQ ID NO: 17726 - DNA, 20 bp, Artificial Sequence
  Synthetic construct
gtagggagcgtcaaggctta

SEQ ID NO: 17727 - DNA, 20 bp, Artificial Sequence
  Synthetic construct
gtagggagcgtcaatgctta

SEQ ID NO: 17728 - DNA, 20 bp, Artificial Sequence
  Synthetic construct
gtagggagcgtcaacactta

SEQ ID NO: 17729 - DNA, 20 bp, Artificial Sequence
  Synthetic construct
gtagggagcgtcaaccctta

SEQ ID NO: 17730 - DNA, 20 bp, Artificial Sequence
  Synthetic construct
gtagggagcgtcaactctta

SEQ ID NO: 17731 - DNA, 20 bp, Artificial Sequence
  Synthetic construct
gtagggagcgtcaacgatta

SEQ ID NO: 17732 - DNA, 20 bp, Artificial Sequence
  Synthetic construct
gtagggagcgtcaacggtta

SEQ ID NO: 17733 - DNA, 20 bp, Artificial Sequence
  Synthetic construct
gtagggagcgtcaacgttta

SEQ ID NO: 17734 - DNA, 20 bp, Artificial Sequence
  Synthetic construct
gtagggagcgtcaacgcata

SEQ ID NO: 17735 - DNA, 20 bp, Artificial Sequence
  Synthetic construct
gtagggagcgtcaacgccta

SEQ ID NO: 17736 - DNA, 20 bp, Artificial Sequence
  Synthetic construct
gtagggagcgtcaacgcgta

SEQ ID NO: 17737 - DNA, 20 bp, Artificial Sequence
  Synthetic construct
gtagggagcgtcaacgctaa

SEQ ID NO: 17738 - DNA, 20 bp, Artificial Sequence
  Synthetic construct
gtagggagcgtcaacgctca

SEQ ID NO: 17739 - DNA, 20 bp, Artificial Sequence
  Synthetic construct
gtagggagcgtcaacgctga

SEQ ID NO: 17740 - DNA, 20 bp, Artificial Sequence
  Synthetic construct
gtagggagcgtcaacgcttc

SEQ ID NO: 17741 - DNA, 20 bp, Artificial Sequence
  Synthetic construct
gtagggagcgtcaacgcttg

SEQ ID NO: 17742 - DNA, 20 bp, Artificial Sequence
  Synthetic construct
gtagggagcgtcaacgcttt

SEQ ID NO: 17743 - DNA, 22 bp, Artificial Sequence
  Synthetic construct
ataacggttgcttgttcagcga

SEQ ID NO: 17744 - DNA, 22 bp, Artificial Sequence
  Synthetic construct
ctaacggttgcttgttcagcga

SEQ ID NO: 17745 - DNA, 22 bp, Artificial Sequence
  Synthetic construct
ttaacggttgcttgttcagcga

SEQ ID NO: 17746 - DNA, 22 bp, Artificial Sequence
  Synthetic construct
gaaacggttgcttgttcagcga

SEQ ID NO: 17747 - DNA, 22 bp, Artificial Sequence
  Synthetic construct
gcaacggttgcttgttcagcga

SEQ ID NO: 17748 - DNA, 22 bp, Artificial Sequence
  Synthetic construct
ggaacggttgcttgttcagcga

SEQ ID NO: 17749 - DNA, 22 bp, Artificial Sequence
  Synthetic construct
gtcacggttgcttgttcagcga

SEQ ID NO: 17750 - DNA, 22 bp, Artificial Sequence
  Synthetic construct
gtgacggttgcttgttcagcga

SEQ ID NO: 17751 - DNA, 22 bp, Artificial Sequence
  Synthetic construct
gttacggttgcttgttcagcga

SEQ ID NO: 17752 - DNA, 22 bp, Artificial Sequence
  Synthetic construct
gtaccggttgcttgttcagcga

SEQ ID NO: 17753 - DNA, 22 bp, Artificial Sequence
  Synthetic construct
gtagcggttgcttgttcagcga

SEQ ID NO: 17754 - DNA, 22 bp, Artificial Sequence
  Synthetic construct
gtatcggttgcttgttcagcga

SEQ ID NO: 17755 - DNA, 22 bp, Artificial Sequence
  Synthetic construct
gtaaaggttgcttgttcagcga

SEQ ID NO: 17756 - DNA, 22 bp, Artificial Sequence
  Synthetic construct
gtaagggttgcttgttcagcga

SEQ ID NO: 17757 - DNA, 22 bp, Artificial Sequence
  Synthetic construct
gtaatggttgcttgttcagcga

SEQ ID NO: 17758 - DNA, 22 bp, Artificial Sequence
  Synthetic construct
gtaacagttgcttgttcagcga

SEQ ID NO: 17759 - DNA, 22 bp, Artificial Sequence
  Synthetic construct
gtaaccgttgcttgttcagcga

SEQ ID NO: 17760 - DNA, 22 bp, Artificial Sequence
  Synthetic construct
gtaactgttgcttgttcagcga

SEQ ID NO: 17761 - DNA, 22 bp, Artificial Sequence
  Synthetic construct
gtaacgattgcttgttcagcga

SEQ ID NO: 17762 - DNA, 22 bp, Artificial Sequence
  Synthetic construct
gtaacgcttgcttgttcagcga

SEQ ID NO: 17763 - DNA, 22 bp, Artificial Sequence
  Synthetic construct
gtaacgtttgcttgttcagcga

SEQ ID NO: 17764 - DNA, 22 bp, Artificial Sequence
  Synthetic construct
gtaacggatgcttgttcagcga

SEQ ID NO: 17765 - DNA, 22 bp, Artificial Sequence
  Synthetic construct
gtaacggctgcttgttcagcga

SEQ ID NO: 17766 - DNA, 22 bp, Artificial Sequence
  Synthetic construct
gtaacgggtgcttgttcagcga

SEQ ID NO: 17767 - DNA, 22 bp, Artificial Sequence
  Synthetic construct
gtaacggtagcttgttcagcga

SEQ ID NO: 17768 - DNA, 22 bp, Artificial Sequence
  Synthetic construct
gtaacggtcgcttgttcagcga

SEQ ID NO: 17769 - DNA, 22 bp, Artificial Sequence
  Synthetic construct
gtaacggtggcttgttcagcga

SEQ ID NO: 17770 - DNA, 22 bp, Artificial Sequence
  Synthetic construct
gtaacggttacttgttcagcga

SEQ ID NO: 17771 - DNA, 22 bp, Artificial Sequence
  Synthetic construct
gtaacggttccttgttcagcga

SEQ ID NO: 17772 - DNA, 22 bp, Artificial Sequence
  Synthetic construct
gtaacggtttcttgttcagcga

SEQ ID NO: 17773 - DNA, 22 bp, Artificial Sequence
  Synthetic construct
gtaacggttgattgttcagcga

SEQ ID NO: 17774 - DNA, 22 bp, Artificial Sequence
  Synthetic construct
gtaacggttggttgttcagcga

SEQ ID NO: 17775 - DNA, 22 bp, Artificial Sequence
  Synthetic construct
gtaacggttgtttgttcagcga

SEQ ID NO: 17776 - DNA, 22 bp, Artificial Sequence
  Synthetic construct
gtaacggttgcatgttcagcga

SEQ ID NO: 17777 - DNA, 22 bp, Artificial Sequence
  Synthetic construct
gtaacggttgcctgttcagcga

SEQ ID NO: 17778 - DNA, 22 bp, Artificial Sequence
  Synthetic construct
gtaacggttgcgtgttcagcga

SEQ ID NO: 17779 - DNA, 22 bp, Artificial Sequence
  Synthetic construct
gtaacggttgctagttcagcga

SEQ ID NO: 17780 - DNA, 22 bp, Artificial Sequence
  Synthetic construct
gtaacggttgctcgttcagcga

SEQ ID NO: 17781 - DNA, 22 bp, Artificial Sequence
  Synthetic construct
gtaacggttgctggttcagcga

SEQ ID NO: 17782 - DNA, 22 bp, Artificial Sequence
  Synthetic construct
gtaacggttgcttattcagcga

SEQ ID NO: 17783 - DNA, 22 bp, Artificial Sequence
  Synthetic construct
gtaacggttgcttcttcagcga

SEQ ID NO: 17784 - DNA, 22 bp, Artificial Sequence
  Synthetic construct
gtaacggttgctttttcagcga

SEQ ID NO: 17785 - DNA, 22 bp, Artificial Sequence
  Synthetic construct
gtaacggttgcttgatcagcga

SEQ ID NO: 17786 - DNA, 22 bp, Artificial Sequence
  Synthetic construct
gtaacggttgcttgctcagcga

SEQ ID NO: 17787 - DNA, 22 bp, Artificial Sequence
  Synthetic construct
gtaacggttgcttggtcagcga

SEQ ID NO: 17788 - DNA, 22 bp, Artificial Sequence
  Synthetic construct
gtaacggttgcttgtacagcga

SEQ ID NO: 17789 - DNA, 22 bp, Artificial Sequence
  Synthetic construct
gtaacggttgcttgtccagcga

SEQ ID NO: 17790 - DNA, 22 bp, Artificial Sequence
  Synthetic construct
gtaacggttgcttgtgcagcga

SEQ ID NO: 17791 - DNA, 22 bp, Artificial Sequence
  Synthetic construct
gtaacggttgcttgttaagcga

SEQ ID NO: 17792 - DNA, 22 bp, Artificial Sequence
  Synthetic construct
gtaacggttgcttgttgagcga

SEQ ID NO: 17793 - DNA, 22 bp, Artificial Sequence
  Synthetic construct
gtaacggttgcttgtttagcga

SEQ ID NO: 17794 - DNA, 22 bp, Artificial Sequence
  Synthetic construct
gtaacggttgcttgttccgcga

SEQ ID NO: 17795 - DNA, 22 bp, Artificial Sequence
  Synthetic construct
gtaacggttgcttgttcggcga

SEQ ID NO: 17796 - DNA, 22 bp, Artificial Sequence
  Synthetic construct
gtaacggttgcttgttctgcga

SEQ ID NO: 17797 - DNA, 22 bp, Artificial Sequence
  Synthetic construct
gtaacggttgcttgttcaacga

SEQ ID NO: 17798 - DNA, 22 bp, Artificial Sequence
  Synthetic construct
gtaacggttgcttgttcaccga

SEQ ID NO: 17799 - DNA, 22 bp, Artificial Sequence
  Synthetic construct
gtaacggttgcttgttcatcga

SEQ ID NO: 17800 - DNA, 22 bp, Artificial Sequence
  Synthetic construct
gtaacggttgcttgttcagaga

SEQ ID NO: 17801 - DNA, 22 bp, Artificial Sequence
  Synthetic construct
gtaacggttgcttgttcaggga

SEQ ID NO: 17802 - DNA, 22 bp, Artificial Sequence
  Synthetic construct
gtaacggttgcttgttcagtga

SEQ ID NO: 17803 - DNA, 22 bp, Artificial Sequence
  Synthetic construct
gtaacggttgcttgttcagcaa

SEQ ID NO: 17804 - DNA, 22 bp, Artificial Sequence
  Synthetic construct
gtaacggttgcttgttcagcca

SEQ ID NO: 17805 - DNA, 22 bp, Artificial Sequence
  Synthetic construct
gtaacggttgcttgttcagcta

SEQ ID NO: 17806 - DNA, 22 bp, Artificial Sequence
  Synthetic construct
gtaacggttgcttgttcagcgc

SEQ ID NO: 17807 - DNA, 22 bp, Artificial Sequence
  Synthetic construct
gtaacggttgcttgttcagcgg

SEQ ID NO: 17808 - DNA, 22 bp, Artificial Sequence
  Synthetic construct
gtaacggttgcttgttcagcgt

SEQ ID NO: 17809 - DNA, 23 bp, Artificial Sequence
  Synthetic construct
atatggttccggcgttaccaaaa

SEQ ID NO: 17810 - DNA, 23 bp, Artificial Sequence
  Synthetic construct
gtatggttccggcgttaccaaaa

SEQ ID NO: 17811 - DNA, 23 bp, Artificial Sequence
  Synthetic construct
ttatggttccggcgttaccaaaa

SEQ ID NO: 17812 - DNA, 23 bp, Artificial Sequence
  Synthetic construct
caatggttccggcgttaccaaaa

SEQ ID NO: 17813 - DNA, 23 bp, Artificial Sequence
  Synthetic construct
ccatggttccggcgttaccaaaa

SEQ ID NO: 17814 - DNA, 23 bp, Artificial Sequence
  Synthetic construct
cgatggttccggcgttaccaaaa

SEQ ID NO: 17815 - DNA, 23 bp, Artificial Sequence
  Synthetic construct
ctctggttccggcgttaccaaaa

SEQ ID NO: 17816 - DNA, 23 bp, Artificial Sequence
  Synthetic construct
ctgtggttccggcgttaccaaaa

SEQ ID NO: 17817 - DNA, 23 bp, Artificial Sequence
  Synthetic construct
ctttggttccggcgttaccaaaa

SEQ ID NO: 17818 - DNA, 23 bp, Artificial Sequence
  Synthetic construct
ctaaggttccggcgttaccaaaa

SEQ ID NO: 17819 - DNA, 23 bp, Artificial Sequence
  Synthetic construct
ctacggttccggcgttaccaaaa

SEQ ID NO: 17820 - DNA, 23 bp, Artificial Sequence
  Synthetic construct
ctagggttccggcgttaccaaaa

SEQ ID NO: 17821 - DNA, 23 bp, Artificial Sequence
  Synthetic construct
ctatagttccggcgttaccaaaa

SEQ ID NO: 17822 - DNA, 23 bp, Artificial Sequence
  Synthetic construct
ctatcgttccggcgttaccaaaa

SEQ ID NO: 17823 - DNA, 23 bp, Artificial Sequence
  Synthetic construct
ctattgttccggcgttaccaaaa

SEQ ID NO: 17824 - DNA, 23 bp, Artificial Sequence
  Synthetic construct
ctatgattccggcgttaccaaaa

SEQ ID NO: 17825 - DNA, 23 bp, Artificial Sequence
  Synthetic construct
ctatgcttccggcgttaccaaaa

SEQ ID NO: 17826 - DNA, 23 bp, Artificial Sequence
  Synthetic construct
ctatgtttccggcgttaccaaaa

SEQ ID NO: 17827 - DNA, 23 bp, Artificial Sequence
  Synthetic construct
ctatggatccggcgttaccaaaa

SEQ ID NO: 17828 - DNA, 23 bp, Artificial Sequence
  Synthetic construct
ctatggctccggcgttaccaaaa

SEQ ID NO: 17829 - DNA, 23 bp, Artificial Sequence
  Synthetic construct
ctatgggtccggcgttaccaaaa

SEQ ID NO: 17830 - DNA, 23 bp, Artificial Sequence
  Synthetic construct
ctatggtaccggcgttaccaaaa

SEQ ID NO: 17831 - DNA, 23 bp, Artificial Sequence
  Synthetic construct
ctatggtcccggcgttaccaaaa

SEQ ID NO: 17832 - DNA, 23 bp, Artificial Sequence
  Synthetic construct
ctatggtgccggcgttaccaaaa

SEQ ID NO: 17833 - DNA, 23 bp, Artificial Sequence
  Synthetic construct
ctatggttacggcgttaccaaaa

SEQ ID NO: 17834 - DNA, 23 bp, Artificial Sequence
  Synthetic construct
ctatggttgcggcgttaccaaaa

SEQ ID NO: 17835 - DNA, 23 bp, Artificial Sequence
  Synthetic construct
ctatggtttcggcgttaccaaaa

SEQ ID NO: 17836 - DNA, 23 bp, Artificial Sequence
  Synthetic construct
ctatggttcaggcgttaccaaaa

SEQ ID NO: 17837 - DNA, 23 bp, Artificial Sequence
  Synthetic construct
ctatggttcgggcgttaccaaaa

SEQ ID NO: 17838 - DNA, 23 bp, Artificial Sequence
  Synthetic construct
ctatggttctggcgttaccaaaa

SEQ ID NO: 17839 - DNA, 23 bp, Artificial Sequence
  Synthetic construct
ctatggttccagcgttaccaaaa

SEQ ID NO: 17840 - DNA, 23 bp, Artificial Sequence
  Synthetic construct
ctatggttcccgcgttaccaaaa

SEQ ID NO: 17841 - DNA, 23 bp, Artificial Sequence
  Synthetic construct
ctatggttcctgcgttaccaaaa

SEQ ID NO: 17842 - DNA, 23 bp, Artificial Sequence
  Synthetic construct
ctatggttccgacgttaccaaaa

SEQ ID NO: 17843 - DNA, 23 bp, Artificial Sequence
  Synthetic construct
ctatggttccgccgttaccaaaa

SEQ ID NO: 17844 - DNA, 23 bp, Artificial Sequence
  Synthetic construct
ctatggttccgtcgttaccaaaa

SEQ ID NO: 17845 - DNA, 23 bp, Artificial Sequence
  Synthetic construct
ctatggttccggagttaccaaaa

SEQ ID NO: 17846 - DNA, 23 bp, Artificial Sequence
  Synthetic construct
ctatggttccggggttaccaaaa

SEQ ID NO: 17847 - DNA, 23 bp, Artificial Sequence
  Synthetic construct
ctatggttccggtgttaccaaaa

SEQ ID NO: 17848 - DNA, 23 bp, Artificial Sequence
  Synthetic construct
ctatggttccggcattaccaaaa

SEQ ID NO: 17849 - DNA, 23 bp, Artificial Sequence
  Synthetic construct
ctatggttccggccttaccaaaa

SEQ ID NO: 17850 - DNA, 23 bp, Artificial Sequence
  Synthetic construct
ctatggttccggctttaccaaaa

SEQ ID NO: 17851 - DNA, 23 bp, Artificial Sequence
  Synthetic construct
ctatggttccggcgataccaaaa

SEQ ID NO: 17852 - DNA, 23 bp, Artificial Sequence
  Synthetic construct
ctatggttccggcgctaccaaaa

SEQ ID NO: 17853 - DNA, 23 bp, Artificial Sequence
  Synthetic construct
ctatggttccggcggtaccaaaa

SEQ ID NO: 17854 - DNA, 23 bp, Artificial Sequence
  Synthetic construct
ctatggttccggcgtaaccaaaa

SEQ ID NO: 17855 - DNA, 23 bp, Artificial Sequence
  Synthetic construct
ctatggttccggcgtcaccaaaa

SEQ ID NO: 17856 - DNA, 23 bp, Artificial Sequence
  Synthetic construct
ctatggttccggcgtgaccaaaa

SEQ ID NO: 17857 - DNA, 23 bp, Artificial Sequence
  Synthetic construct
ctatggttccggcgttcccaaaa

SEQ ID NO: 17858 - DNA, 23 bp, Artificial Sequence
  Synthetic construct
ctatggttccggcgttgccaaaa

SEQ ID NO: 17859 - DNA, 23 bp, Artificial Sequence
  Synthetic construct
ctatggttccggcgtttccaaaa

SEQ ID NO: 17860 - DNA, 23 bp, Artificial Sequence
  Synthetic construct
ctatggttccggcgttaacaaaa

SEQ ID NO: 17861 - DNA, 23 bp, Artificial Sequence
  Synthetic construct
ctatggttccggcgttagcaaaa

SEQ ID NO: 17862 - DNA, 23 bp, Artificial Sequence
  Synthetic construct
ctatggttccggcgttatcaaaa

SEQ ID NO: 17863 - DNA, 23 bp, Artificial Sequence
  Synthetic construct
ctatggttccggcgttacaaaaa

SEQ ID NO: 17864 - DNA, 23 bp, Artificial Sequence
  Synthetic construct
ctatggttccggcgttacgaaaa

SEQ ID NO: 17865 - DNA, 23 bp, Artificial Sequence
  Synthetic construct
ctatggttccggcgttactaaaa

SEQ ID NO: 17866 - DNA, 23 bp, Artificial Sequence
  Synthetic construct
ctatggttccggcgttacccaaa

SEQ ID NO: 17867 - DNA, 23 bp, Artificial Sequence
  Synthetic construct
ctatggttccggcgttaccgaaa

SEQ ID NO: 17868 - DNA, 23 bp, Artificial Sequence
  Synthetic construct
ctatggttccggcgttacctaaa

SEQ ID NO: 17869 - DNA, 23 bp, Artificial Sequence
  Synthetic construct
ctatggttccggcgttaccacaa

SEQ ID NO: 17870 - DNA, 23 bp, Artificial Sequence
  Synthetic construct
ctatggttccggcgttaccagaa

SEQ ID NO: 17871 - DNA, 23 bp, Artificial Sequence
  Synthetic construct
ctatggttccggcgttaccataa

SEQ ID NO: 17872 - DNA, 23 bp, Artificial Sequence
  Synthetic construct
ctatggttccggcgttaccaaca

SEQ ID NO: 17873 - DNA, 23 bp, Artificial Sequence
  Synthetic construct
ctatggttccggcgttaccaaga

SEQ ID NO: 17874 - DNA, 23 bp, Artificial Sequence
  Synthetic construct
ctatggttccggcgttaccaata

SEQ ID NO: 17875 - DNA, 23 bp, Artificial Sequence
  Synthetic construct
ctatggttccggcgttaccaaac

SEQ ID NO: 17876 - DNA, 23 bp, Artificial Sequence
  Synthetic construct
ctatggttccggcgttaccaaag

SEQ ID NO: 17877 - DNA, 23 bp, Artificial Sequence
  Synthetic construct
ctatggttccggcgttaccaaat

SEQ ID NO: 17878 - DNA, 23 bp, Artificial Sequence
  Synthetic construct
agaggggacgaaggtctcgttct

SEQ ID NO: 17879 - DNA, 23 bp, Artificial Sequence
  Synthetic construct
cgaggggacgaaggtctcgttct

SEQ ID NO: 17880 - DNA, 23 bp, Artificial Sequence
  Synthetic construct
tgaggggacgaaggtctcgttct

SEQ ID NO: 17881 - DNA, 23 bp, Artificial Sequence
  Synthetic construct
gaaggggacgaaggtctcgttct

SEQ ID NO: 17882 - DNA, 23 bp, Artificial Sequence
  Synthetic construct
gcaggggacgaaggtctcgttct

SEQ ID NO: 17883 - DNA, 23 bp, Artificial Sequence
  Synthetic construct
gtaggggacgaaggtctcgttct

SEQ ID NO: 17884 - DNA, 23 bp, Artificial Sequence
  Synthetic construct
ggcggggacgaaggtctcgttct

SEQ ID NO: 17885 - DNA, 23 bp, Artificial Sequence
  Synthetic construct
gggggggacgaaggtctcgttct

SEQ ID NO: 17886 - DNA, 23 bp, Artificial Sequence
  Synthetic construct
ggtggggacgaaggtctcgttct

SEQ ID NO: 17887 - DNA, 23 bp, Artificial Sequence
  Synthetic construct
ggaagggacgaaggtctcgttct

SEQ ID NO: 17888 - DNA, 23 bp, Artificial Sequence
  Synthetic construct
ggacgggacgaaggtctcgttct

SEQ ID NO: 17889 - DNA, 23 bp, Artificial Sequence
  Synthetic construct
ggatgggacgaaggtctcgttct

SEQ ID NO: 17890 - DNA, 23 bp, Artificial Sequence
  Synthetic construct
ggagaggacgaaggtctcgttct

SEQ ID NO: 17891 - DNA, 23 bp, Artificial Sequence
  Synthetic construct
ggagcggacgaaggtctcgttct

SEQ ID NO: 17892 - DNA, 23 bp, Artificial Sequence
  Synthetic construct
ggagtggacgaaggtctcgttct

SEQ ID NO: 17893 - DNA, 23 bp, Artificial Sequence
  Synthetic construct
ggaggagacgaaggtctcgttct

SEQ ID NO: 17894 - DNA, 23 bp, Artificial Sequence
  Synthetic construct
ggaggcgacgaaggtctcgttct

SEQ ID NO: 17895 - DNA, 23 bp, Artificial Sequence
  Synthetic construct
ggaggtgacgaaggtctcgttct

SEQ ID NO: 17896 - DNA, 23 bp, Artificial Sequence
  Synthetic construct
ggagggaacgaaggtctcgttct

SEQ ID NO: 17897 - DNA, 23 bp, Artificial Sequence
  Synthetic construct
ggagggcacgaaggtctcgttct

SEQ ID NO: 17898 - DNA, 23 bp, Artificial Sequence
  Synthetic construct
ggagggtacgaaggtctcgttct

SEQ ID NO: 17899 - DNA, 23 bp, Artificial Sequence
  Synthetic construct
ggaggggccgaaggtctcgttct

SEQ ID NO: 17900 - DNA, 23 bp, Artificial Sequence
  Synthetic construct
ggagggggcgaaggtctcgttct

SEQ ID NO: 17901 - DNA, 23 bp, Artificial Sequence
  Synthetic construct
ggaggggtcgaaggtctcgttct

SEQ ID NO: 17902 - DNA, 23 bp, Artificial Sequence
  Synthetic construct
ggaggggaagaaggtctcgttct

SEQ ID NO: 17903 - DNA, 23 bp, Artificial Sequence
  Synthetic construct
ggaggggaggaaggtctcgttct

SEQ ID NO: 17904 - DNA, 23 bp, Artificial Sequence
  Synthetic construct
ggaggggatgaaggtctcgttct

SEQ ID NO: 17905 - DNA, 23 bp, Artificial Sequence
  Synthetic construct
ggaggggacaaaggtctcgttct

SEQ ID NO: 17906 - DNA, 23 bp, Artificial Sequence
  Synthetic construct
ggaggggaccaaggtctcgttct

SEQ ID NO: 17907 - DNA, 23 bp, Artificial Sequence
  Synthetic construct
ggaggggactaaggtctcgttct

SEQ ID NO: 17908 - DNA, 23 bp, Artificial Sequence
  Synthetic construct
ggaggggacgcaggtctcgttct

SEQ ID NO: 17909 - DNA, 23 bp, Artificial Sequence
  Synthetic construct
ggaggggacggaggtctcgttct

SEQ ID NO: 17910 - DNA, 23 bp, Artificial Sequence
  Synthetic construct
ggaggggacgtaggtctcgttct

SEQ ID NO: 17911 - DNA, 23 bp, Artificial Sequence
  Synthetic construct
ggaggggacgacggtctcgttct

SEQ ID NO: 17912 - DNA, 23 bp, Artificial Sequence
  Synthetic construct
ggaggggacgagggtctcgttct

SEQ ID NO: 17913 - DNA, 23 bp, Artificial Sequence
  Synthetic construct
ggaggggacgatggtctcgttct

SEQ ID NO: 17914 - DNA, 23 bp, Artificial Sequence
  Synthetic construct
ggaggggacgaaagtctcgttct

SEQ ID NO: 17915 - DNA, 23 bp, Artificial Sequence
  Synthetic construct
ggaggggacgaacgtctcgttct

SEQ ID NO: 17916 - DNA, 23 bp, Artificial Sequence
  Synthetic construct
ggaggggacgaatgtctcgttct

SEQ ID NO: 17917 - DNA, 23 bp, Artificial Sequence
  Synthetic construct
ggaggggacgaagatctcgttct

SEQ ID NO: 17918 - DNA, 23 bp, Artificial Sequence
  Synthetic construct
ggaggggacgaagctctcgttct

SEQ ID NO: 17919 - DNA, 23 bp, Artificial Sequence
  Synthetic construct
ggaggggacgaagttctcgttct

SEQ ID NO: 17920 - DNA, 23 bp, Artificial Sequence
  Synthetic construct
ggaggggacgaaggactcgttct

SEQ ID NO: 17921 - DNA, 23 bp, Artificial Sequence
  Synthetic construct
ggaggggacgaaggcctcgttct

SEQ ID NO: 17922 - DNA, 23 bp, Artificial Sequence
  Synthetic construct
ggaggggacgaagggctcgttct

SEQ ID NO: 17923 - DNA, 23 bp, Artificial Sequence
  Synthetic construct
ggaggggacgaaggtatcgttct

SEQ ID NO: 17924 - DNA, 23 bp, Artificial Sequence
  Synthetic construct
ggaggggacgaaggtgtcgttct

SEQ ID NO: 17925 - DNA, 23 bp, Artificial Sequence
  Synthetic construct
ggaggggacgaaggtttcgttct

SEQ ID NO: 17926 - DNA, 23 bp, Artificial Sequence
  Synthetic construct
ggaggggacgaaggtcacgttct

SEQ ID NO: 17927 - DNA, 23 bp, Artificial Sequence
  Synthetic construct
ggaggggacgaaggtcccgttct

SEQ ID NO: 17928 - DNA, 23 bp, Artificial Sequence
  Synthetic construct
ggaggggacgaaggtcgcgttct

SEQ ID NO: 17929 - DNA, 23 bp, Artificial Sequence
  Synthetic construct
ggaggggacgaaggtctagttct

SEQ ID NO: 17930 - DNA, 23 bp, Artificial Sequence
  Synthetic construct
ggaggggacgaaggtctggttct

SEQ ID NO: 17931 - DNA, 23 bp, Artificial Sequence
  Synthetic construct
ggaggggacgaaggtcttgttct

SEQ ID NO: 17932 - DNA, 23 bp, Artificial Sequence
  Synthetic construct
ggaggggacgaaggtctcattct

SEQ ID NO: 17933 - DNA, 23 bp, Artificial Sequence
  Synthetic construct
ggaggggacgaaggtctccttct

SEQ ID NO: 17934 - DNA, 23 bp, Artificial Sequence
  Synthetic construct
ggaggggacgaaggtctctttct

SEQ ID NO: 17935 - DNA, 23 bp, Artificial Sequence
  Synthetic construct
ggaggggacgaaggtctcgatct

SEQ ID NO: 17936 - DNA, 23 bp, Artificial Sequence
  Synthetic construct
ggaggggacgaaggtctcgctct

SEQ ID NO: 17937 - DNA, 23 bp, Artificial Sequence
  Synthetic construct
ggaggggacgaaggtctcggtct

SEQ ID NO: 17938 - DNA, 23 bp, Artificial Sequence
  Synthetic construct
ggaggggacgaaggtctcgtact

SEQ ID NO: 17939 - DNA, 23 bp, Artificial Sequence
  Synthetic construct
ggaggggacgaaggtctcgtcct

SEQ ID NO: 17940 - DNA, 23 bp, Artificial Sequence
  Synthetic construct
ggaggggacgaaggtctcgtgct

SEQ ID NO: 17941 - DNA, 23 bp, Artificial Sequence
  Synthetic construct
ggaggggacgaaggtctcgttat

SEQ ID NO: 17942 - DNA, 23 bp, Artificial Sequence
  Synthetic construct
ggaggggacgaaggtctcgttgt

SEQ ID NO: 17943 - DNA, 23 bp, Artificial Sequence
  Synthetic construct
ggaggggacgaaggtctcgtttt

SEQ ID NO: 17944 - DNA, 23 bp, Artificial Sequence
  Synthetic construct
ggaggggacgaaggtctcgttca

SEQ ID NO: 17945 - DNA, 23 bp, Artificial Sequence
  Synthetic construct
ggaggggacgaaggtctcgttcc

SEQ ID NO: 17946 - DNA, 23 bp, Artificial Sequence
  Synthetic construct
ggaggggacgaaggtctcgttcg

SEQ ID NO: 17947 - DNA, 20 bp, Artificial Sequence
  Synthetic construct
cctttacgtacgcgccagtt

SEQ ID NO: 17948 - DNA, 20 bp, Artificial Sequence
  Synthetic construct
gctttacgtacgcgccagtt

SEQ ID NO: 17949 - DNA, 20 bp, Artificial Sequence
  Synthetic construct
tctttacgtacgcgccagtt

SEQ ID NO: 17950 - DNA, 20 bp, Artificial Sequence
  Synthetic construct
aatttacgtacgcgccagtt

SEQ ID NO: 17951 - DNA, 20 bp, Artificial Sequence
  Synthetic construct
agtttacgtacgcgccagtt

SEQ ID NO: 17952 - DNA, 20 bp, Artificial Sequence
  Synthetic construct
attttacgtacgcgccagtt

SEQ ID NO: 17953 - DNA, 20 bp, Artificial Sequence
  Synthetic construct
acattacgtacgcgccagtt

SEQ ID NO: 17954 - DNA, 20 bp, Artificial Sequence
  Synthetic construct
accttacgtacgcgccagtt

SEQ ID NO: 17955 - DNA, 20 bp, Artificial Sequence
  Synthetic construct
acgttacgtacgcgccagtt

SEQ ID NO: 17956 - DNA, 20 bp, Artificial Sequence
  Synthetic construct
actatacgtacgcgccagtt

SEQ ID NO: 17957 - DNA, 20 bp, Artificial Sequence
  Synthetic construct
actctacgtacgcgccagtt

SEQ ID NO: 17958 - DNA, 20 bp, Artificial Sequence
  Synthetic construct
actgtacgtacgcgccagtt

SEQ ID NO: 17959 - DNA, 20 bp, Artificial Sequence
  Synthetic construct
acttaacgtacgcgccagtt

SEQ ID NO: 17960 - DNA, 20 bp, Artificial Sequence
  Synthetic construct
acttcacgtacgcgccagtt

SEQ ID NO: 17961 - DNA, 20 bp, Artificial Sequence
  Synthetic construct
acttgacgtacgcgccagtt

SEQ ID NO: 17962 - DNA, 20 bp, Artificial Sequence
  Synthetic construct
actttccgtacgcgccagtt

SEQ ID NO: 17963 - DNA, 20 bp, Artificial Sequence
  Synthetic construct
actttgcgtacgcgccagtt

SEQ ID NO: 17964 - DNA, 20 bp, Artificial Sequence
  Synthetic construct
acttttcgtacgcgccagtt

SEQ ID NO: 17965 - DNA, 20 bp, Artificial Sequence
  Synthetic construct
actttaagtacgcgccagtt

SEQ ID NO: 17966 - DNA, 20 bp, Artificial Sequence
  Synthetic construct
actttaggtacgcgccagtt

SEQ ID NO: 17967 - DNA, 20 bp, Artificial Sequence
  Synthetic construct
actttatgtacgcgccagtt

SEQ ID NO: 17968 - DNA, 20 bp, Artificial Sequence
  Synthetic construct
actttacatacgcgccagtt

SEQ ID NO: 17969 - DNA, 20 bp, Artificial Sequence
  Synthetic construct
actttacctacgcgccagtt

SEQ ID NO: 17970 - DNA, 20 bp, Artificial Sequence
  Synthetic construct
actttacttacgcgccagtt

SEQ ID NO: 17971 - DNA, 20 bp, Artificial Sequence
  Synthetic construct
actttacgaacgcgccagtt

SEQ ID NO: 17972 - DNA, 20 bp, Artificial Sequence
  Synthetic construct
actttacgcacgcgccagtt

SEQ ID NO: 17973 - DNA, 20 bp, Artificial Sequence
  Synthetic construct
actttacggacgcgccagtt

SEQ ID NO: 17974 - DNA, 20 bp, Artificial Sequence
  Synthetic construct
actttacgtccgcgccagtt

SEQ ID NO: 17975 - DNA, 20 bp, Artificial Sequence
  Synthetic construct
actttacgtgcgcgccagtt

SEQ ID NO: 17976 - DNA, 20 bp, Artificial Sequence
  Synthetic construct
actttacgttcgcgccagtt

SEQ ID NO: 17977 - DNA, 20 bp, Artificial Sequence
  Synthetic construct
actttacgtaagcgccagtt

SEQ ID NO: 17978 - DNA, 20 bp, Artificial Sequence
  Synthetic construct
actttacgtaggcgccagtt

SEQ ID NO: 17979 - DNA, 20 bp, Artificial Sequence
  Synthetic construct
actttacgtatgcgccagtt

SEQ ID NO: 17980 - DNA, 20 bp, Artificial Sequence
  Synthetic construct
actttacgtacacgccagtt

SEQ ID NO: 17981 - DNA, 20 bp, Artificial Sequence
  Synthetic construct
actttacgtacccgccagtt

SEQ ID NO: 17982 - DNA, 20 bp, Artificial Sequence
  Synthetic construct
actttacgtactcgccagtt

SEQ ID NO: 17983 - DNA, 20 bp, Artificial Sequence
  Synthetic construct
actttacgtacgagccagtt

SEQ ID NO: 17984 - DNA, 20 bp, Artificial Sequence
  Synthetic construct
actttacgtacgggccagtt

SEQ ID NO: 17985 - DNA, 20 bp, Artificial Sequence
  Synthetic construct
actttacgtacgtgccagtt

SEQ ID NO: 17986 - DNA, 20 bp, Artificial Sequence
  Synthetic construct
actttacgtacgcaccagtt

SEQ ID NO: 17987 - DNA, 20 bp, Artificial Sequence
  Synthetic construct
actttacgtacgccccagtt

SEQ ID NO: 17988 - DNA, 20 bp, Artificial Sequence
  Synthetic construct
actttacgtacgctccagtt

SEQ ID NO: 17989 - DNA, 20 bp, Artificial Sequence
  Synthetic construct
actttacgtacgcgacagtt

SEQ ID NO: 17990 - DNA, 20 bp, Artificial Sequence
  Synthetic construct
actttacgtacgcggcagtt

SEQ ID NO: 17991 - DNA, 20 bp, Artificial Sequence
  Synthetic construct
actttacgtacgcgtcagtt

SEQ ID NO: 17992 - DNA, 20 bp, Artificial Sequence
  Synthetic construct
actttacgtacgcgcaagtt

SEQ ID NO: 17993 - DNA, 20 bp, Artificial Sequence
  Synthetic construct
actttacgtacgcgcgagtt

SEQ ID NO: 17994 - DNA, 20 bp, Artificial Sequence
  Synthetic construct
actttacgtacgcgctagtt

SEQ ID NO: 17995 - DNA, 20 bp, Artificial Sequence
  Synthetic construct
actttacgtacgcgcccgtt

SEQ ID NO: 17996 - DNA, 20 bp, Artificial Sequence
  Synthetic construct
actttacgtacgcgccggtt

SEQ ID NO: 17997 - DNA, 20 bp, Artificial Sequence
  Synthetic construct
actttacgtacgcgcctgtt

SEQ ID NO: 17998 - DNA, 20 bp, Artificial Sequence
  Synthetic construct
actttacgtacgcgccaatt

SEQ ID NO: 17999 - DNA, 20 bp, Artificial Sequence
  Synthetic construct
actttacgtacgcgccactt

SEQ ID NO: 18000 - DNA, 20 bp, Artificial Sequence
  Synthetic construct
actttacgtacgcgccattt

SEQ ID NO: 18001 - DNA, 20 bp, Artificial Sequence
  Synthetic construct
actttacgtacgcgccagat

SEQ ID NO: 18002 - DNA, 20 bp, Artificial Sequence
  Synthetic construct
actttacgtacgcgccagct

SEQ ID NO: 18003 - DNA, 20 bp, Artificial Sequence
  Synthetic construct
actttacgtacgcgccaggt

SEQ ID NO: 18004 - DNA, 20 bp, Artificial Sequence
  Synthetic construct
actttacgtacgcgccagta

SEQ ID NO: 18005 - DNA, 20 bp, Artificial Sequence
  Synthetic construct
actttacgtacgcgccagtc

SEQ ID NO: 18006 - DNA, 20 bp, Artificial Sequence
  Synthetic construct
actttacgtacgcgccagtg

SEQ ID NO: 18007 - DNA, 20 bp, Artificial Sequence
  Synthetic construct
aaagagattgtcaacaggtt

SEQ ID NO: 18008 - DNA, 20 bp, Artificial Sequence
  Synthetic construct
caagagattgtcaacaggtt

SEQ ID NO: 18009 - DNA, 20 bp, Artificial Sequence
  Synthetic construct
taagagattgtcaacaggtt

SEQ ID NO: 18010 - DNA, 20 bp, Artificial Sequence
  Synthetic construct
gcagagattgtcaacaggtt

SEQ ID NO: 18011 - DNA, 20 bp, Artificial Sequence
  Synthetic construct
ggagagattgtcaacaggtt

SEQ ID NO: 18012 - DNA, 20 bp, Artificial Sequence
  Synthetic construct
gtagagattgtcaacaggtt

SEQ ID NO: 18013 - DNA, 20 bp, Artificial Sequence
  Synthetic construct
gacgagattgtcaacaggtt

SEQ ID NO: 18014 - DNA, 20 bp, Artificial Sequence
  Synthetic construct
gaggagattgtcaacaggtt

SEQ ID NO: 18015 - DNA, 20 bp, Artificial Sequence
  Synthetic construct
gatgagattgtcaacaggtt

SEQ ID NO: 18016 - DNA, 20 bp, Artificial Sequence
  Synthetic construct
gaaaagattgtcaacaggtt

SEQ ID NO: 18017 - DNA, 20 bp, Artificial Sequence
  Synthetic construct
gaacagattgtcaacaggtt

SEQ ID NO: 18018 - DNA, 20 bp, Artificial Sequence
  Synthetic construct
gaatagattgtcaacaggtt

SEQ ID NO: 18019 - DNA, 20 bp, Artificial Sequence
  Synthetic construct
gaagcgattgtcaacaggtt

SEQ ID NO: 18020 - DNA, 20 bp, Artificial Sequence
  Synthetic construct
gaagggattgtcaacaggtt

SEQ ID NO: 18021 - DNA, 20 bp, Artificial Sequence
  Synthetic construct
gaagtgattgtcaacaggtt

SEQ ID NO: 18022 - DNA, 20 bp, Artificial Sequence
  Synthetic construct
gaagaaattgtcaacaggtt

SEQ ID NO: 18023 - DNA, 20 bp, Artificial Sequence
  Synthetic construct
gaagacattgtcaacaggtt

SEQ ID NO: 18024 - DNA, 20 bp, Artificial Sequence
  Synthetic construct
gaagatattgtcaacaggtt

SEQ ID NO: 18025 - DNA, 20 bp, Artificial Sequence
  Synthetic construct
gaagagcttgtcaacaggtt

SEQ ID NO: 18026 - DNA, 20 bp, Artificial Sequence
  Synthetic construct
gaagaggttgtcaacaggtt

SEQ ID NO: 18027 - DNA, 20 bp, Artificial Sequence
  Synthetic construct
gaagagtttgtcaacaggtt

SEQ ID NO: 18028 - DNA, 20 bp, Artificial Sequence
  Synthetic construct
gaagagaatgtcaacaggtt

SEQ ID NO: 18029 - DNA, 20 bp, Artificial Sequence
  Synthetic construct
gaagagactgtcaacaggtt

SEQ ID NO: 18030 - DNA, 20 bp, Artificial Sequence
  Synthetic construct
gaagagagtgtcaacaggtt

SEQ ID NO: 18031 - DNA, 20 bp, Artificial Sequence
  Synthetic construct
gaagagatagtcaacaggtt

SEQ ID NO: 18032 - DNA, 20 bp, Artificial Sequence
  Synthetic construct
gaagagatcgtcaacaggtt

SEQ ID NO: 18033 - DNA, 20 bp, Artificial Sequence
  Synthetic construct
gaagagatggtcaacaggtt

SEQ ID NO: 18034 - DNA, 20 bp, Artificial Sequence
  Synthetic construct
gaagagattatcaacaggtt

SEQ ID NO: 18035 - DNA, 20 bp, Artificial Sequence
  Synthetic construct
gaagagattctcaacaggtt

SEQ ID NO: 18036 - DNA, 20 bp, Artificial Sequence
  Synthetic construct
gaagagattttcaacaggtt

SEQ ID NO: 18037 - DNA, 20 bp, Artificial Sequence
  Synthetic construct
gaagagattgacaacaggtt

SEQ ID NO: 18038 - DNA, 20 bp, Artificial Sequence
  Synthetic construct
gaagagattgccaacaggtt

SEQ ID NO: 18039 - DNA, 20 bp, Artificial Sequence
  Synthetic construct
gaagagattggcaacaggtt

SEQ ID NO: 18040 - DNA, 20 bp, Artificial Sequence
  Synthetic construct
gaagagattgtaaacaggtt

SEQ ID NO: 18041 - DNA, 20 bp, Artificial Sequence
  Synthetic construct
gaagagattgtgaacaggtt

SEQ ID NO: 18042 - DNA, 20 bp, Artificial Sequence
  Synthetic construct
gaagagattgttaacaggtt

SEQ ID NO: 18043 - DNA, 20 bp, Artificial Sequence
  Synthetic construct
gaagagattgtccacaggtt

SEQ ID NO: 18044 - DNA, 20 bp, Artificial Sequence
  Synthetic construct
gaagagattgtcgacaggtt

SEQ ID NO: 18045 - DNA, 20 bp, Artificial Sequence
  Synthetic construct
gaagagattgtctacaggtt

SEQ ID NO: 18046 - DNA, 20 bp, Artificial Sequence
  Synthetic construct
gaagagattgtcaccaggtt

SEQ ID NO: 18047 - DNA, 20 bp, Artificial Sequence
  Synthetic construct
gaagagattgtcagcaggtt

SEQ ID NO: 18048 - DNA, 20 bp, Artificial Sequence
  Synthetic construct
gaagagattgtcatcaggtt

SEQ ID NO: 18049 - DNA, 20 bp, Artificial Sequence
  Synthetic construct
gaagagattgtcaaaaggtt

SEQ ID NO: 18050 - DNA, 20 bp, Artificial Sequence
  Synthetic construct
gaagagattgtcaagaggtt

SEQ ID NO: 18051 - DNA, 20 bp, Artificial Sequence
  Synthetic construct
gaagagattgtcaataggtt

SEQ ID NO: 18052 - DNA, 20 bp, Artificial Sequence
  Synthetic construct
gaagagattgtcaaccggtt

SEQ ID NO: 18053 - DNA, 20 bp, Artificial Sequence
  Synthetic construct
gaagagattgtcaacgggtt

SEQ ID NO: 18054 - DNA, 20 bp, Artificial Sequence
  Synthetic construct
gaagagattgtcaactggtt

SEQ ID NO: 18055 - DNA, 20 bp, Artificial Sequence
  Synthetic construct
gaagagattgtcaacaagtt

SEQ ID NO: 18056 - DNA, 20 bp, Artificial Sequence
  Synthetic construct
gaagagattgtcaacacgtt

SEQ ID NO: 18057 - DNA, 20 bp, Artificial Sequence
  Synthetic construct
gaagagattgtcaacatgtt

SEQ ID NO: 18058 - DNA, 20 bp, Artificial Sequence
  Synthetic construct
gaagagattgtcaacagatt

SEQ ID NO: 18059 - DNA, 20 bp, Artificial Sequence
  Synthetic construct
gaagagattgtcaacagctt

SEQ ID NO: 18060 - DNA, 20 bp, Artificial Sequence
  Synthetic construct
gaagagattgtcaacagttt

SEQ ID NO: 18061 - DNA, 20 bp, Artificial Sequence
  Synthetic construct
gaagagattgtcaacaggat

SEQ ID NO: 18062 - DNA, 20 bp, Artificial Sequence
  Synthetic construct
gaagagattgtcaacaggct

SEQ ID NO: 18063 - DNA, 20 bp, Artificial Sequence
  Synthetic construct
gaagagattgtcaacagggt

SEQ ID NO: 18064 - DNA, 20 bp, Artificial Sequence
  Synthetic construct
gaagagattgtcaacaggta

SEQ ID NO: 18065 - DNA, 20 bp, Artificial Sequence
  Synthetic construct
gaagagattgtcaacaggtc

SEQ ID NO: 18066 - DNA, 20 bp, Artificial Sequence
  Synthetic construct
gaagagattgtcaacaggtg

SEQ ID NO: 18067 - DNA, 23 bp, Artificial Sequence
  Synthetic construct
aactcacccgttattacgtcagt

SEQ ID NO: 18068 - DNA, 23 bp, Artificial Sequence
  Synthetic construct
cactcacccgttattacgtcagt

SEQ ID NO: 18069 - DNA, 23 bp, Artificial Sequence
  Synthetic construct
tactcacccgttattacgtcagt

SEQ ID NO: 18070 - DNA, 23 bp, Artificial Sequence
  Synthetic construct
gcctcacccgttattacgtcagt

SEQ ID NO: 18071 - DNA, 23 bp, Artificial Sequence
  Synthetic construct
ggctcacccgttattacgtcagt

SEQ ID NO: 18072 - DNA, 23 bp, Artificial Sequence
  Synthetic construct
gtctcacccgttattacgtcagt

SEQ ID NO: 18073 - DNA, 23 bp, Artificial Sequence
  Synthetic construct
gaatcacccgttattacgtcagt

SEQ ID NO: 18074 - DNA, 23 bp, Artificial Sequence
  Synthetic construct
gagtcacccgttattacgtcagt

SEQ ID NO: 18075 - DNA, 23 bp, Artificial Sequence
  Synthetic construct
gattcacccgttattacgtcagt

SEQ ID NO: 18076 - DNA, 23 bp, Artificial Sequence
  Synthetic construct
gacacacccgttattacgtcagt

SEQ ID NO: 18077 - DNA, 23 bp, Artificial Sequence
  Synthetic construct
gacccacccgttattacgtcagt

SEQ ID NO: 18078 - DNA, 23 bp, Artificial Sequence
  Synthetic construct
gacgcacccgttattacgtcagt

SEQ ID NO: 18079 - DNA, 23 bp, Artificial Sequence
  Synthetic construct
gactaacccgttattacgtcagt

SEQ ID NO: 18080 - DNA, 23 bp, Artificial Sequence
  Synthetic construct
gactgacccgttattacgtcagt

SEQ ID NO: 18081 - DNA, 23 bp, Artificial Sequence
  Synthetic construct
gacttacccgttattacgtcagt

SEQ ID NO: 18082 - DNA, 23 bp, Artificial Sequence
  Synthetic construct
gactcccccgttattacgtcagt

SEQ ID NO: 18083 - DNA, 23 bp, Artificial Sequence
  Synthetic construct
gactcgcccgttattacgtcagt

SEQ ID NO: 18084 - DNA, 23 bp, Artificial Sequence
  Synthetic construct
gactctcccgttattacgtcagt

SEQ ID NO: 18085 - DNA, 23 bp, Artificial Sequence
  Synthetic construct
gactcaaccgttattacgtcagt

SEQ ID NO: 18086 - DNA, 23 bp, Artificial Sequence
  Synthetic construct
gactcagccgttattacgtcagt

SEQ ID NO: 18087 - DNA, 23 bp, Artificial Sequence
  Synthetic construct
gactcatccgttattacgtcagt

SEQ ID NO: 18088 - DNA, 23 bp, Artificial Sequence
  Synthetic construct
gactcacacgttattacgtcagt

SEQ ID NO: 18089 - DNA, 23 bp, Artificial Sequence
  Synthetic construct
gactcacgcgttattacgtcagt

SEQ ID NO: 18090 - DNA, 23 bp, Artificial Sequence
  Synthetic construct
gactcactcgttattacgtcagt

SEQ ID NO: 18091 - DNA, 23 bp, Artificial Sequence
  Synthetic construct
gactcaccagttattacgtcagt

SEQ ID NO: 18092 - DNA, 23 bp, Artificial Sequence
  Synthetic construct
gactcaccggttattacgtcagt

SEQ ID NO: 18093 - DNA, 23 bp, Artificial Sequence
  Synthetic construct
gactcacctgttattacgtcagt

SEQ ID NO: 18094 - DNA, 23 bp, Artificial Sequence
  Synthetic construct
gactcacccattattacgtcagt

SEQ ID NO: 18095 - DNA, 23 bp, Artificial Sequence
  Synthetic construct
gactcaccccttattacgtcagt

SEQ ID NO: 18096 - DNA, 23 bp, Artificial Sequence
  Synthetic construct
gactcaccctttattacgtcagt

SEQ ID NO: 18097 - DNA, 23 bp, Artificial Sequence
  Synthetic construct
gactcacccgatattacgtcagt

SEQ ID NO: 18098 - DNA, 23 bp, Artificial Sequence
  Synthetic construct
gactcacccgctattacgtcagt

SEQ ID NO: 18099 - DNA, 23 bp, Artificial Sequence
  Synthetic construct
gactcacccggtattacgtcagt

SEQ ID NO: 18100 - DNA, 23 bp, Artificial Sequence
  Synthetic construct
gactcacccgtaattacgtcagt

SEQ ID NO: 18101 - DNA, 23 bp, Artificial Sequence
  Synthetic construct
gactcacccgtcattacgtcagt

SEQ ID NO: 18102 - DNA, 23 bp, Artificial Sequence
  Synthetic construct
gactcacccgtgattacgtcagt

SEQ ID NO: 18103 - DNA, 23 bp, Artificial Sequence
  Synthetic construct
gactcacccgttcttacgtcagt

SEQ ID NO: 18104 - DNA, 23 bp, Artificial Sequence
  Synthetic construct
gactcacccgttgttacgtcagt

SEQ ID NO: 18105 - DNA, 23 bp, Artificial Sequence
  Synthetic construct
gactcacccgtttttacgtcagt

SEQ ID NO: 18106 - DNA, 23 bp, Artificial Sequence
  Synthetic construct
gactcacccgttaatacgtcagt

SEQ ID NO: 18107 - DNA, 23 bp, Artificial Sequence
  Synthetic construct
gactcacccgttactacgtcagt

SEQ ID NO: 18108 - DNA, 23 bp, Artificial Sequence
  Synthetic construct
gactcacccgttagtacgtcagt

SEQ ID NO: 18109 - DNA, 23 bp, Artificial Sequence
  Synthetic construct
gactcacccgttataacgtcagt

SEQ ID NO: 18110 - DNA, 23 bp, Artificial Sequence
  Synthetic construct
gactcacccgttatcacgtcagt

SEQ ID NO: 18111 - DNA, 23 bp, Artificial Sequence
  Synthetic construct
gactcacccgttatgacgtcagt

SEQ ID NO: 18112 - DNA, 23 bp, Artificial Sequence
  Synthetic construct
gactcacccgttattccgtcagt

SEQ ID NO: 18113 - DNA, 23 bp, Artificial Sequence
  Synthetic construct
gactcacccgttattgcgtcagt

SEQ ID NO: 18114 - DNA, 23 bp, Artificial Sequence
  Synthetic construct
gactcacccgttatttcgtcagt

SEQ ID NO: 18115 - DNA, 23 bp, Artificial Sequence
  Synthetic construct
gactcacccgttattaagtcagt

SEQ ID NO: 18116 - DNA, 23 bp, Artificial Sequence
  Synthetic construct
gactcacccgttattaggtcagt

SEQ ID NO: 18117 - DNA, 23 bp, Artificial Sequence
  Synthetic construct
gactcacccgttattatgtcagt

SEQ ID NO: 18118 - DNA, 23 bp, Artificial Sequence
  Synthetic construct
gactcacccgttattacatcagt

SEQ ID NO: 18119 - DNA, 23 bp, Artificial Sequence
  Synthetic construct
gactcacccgttattacctcagt

SEQ ID NO: 18120 - DNA, 23 bp, Artificial Sequence
  Synthetic construct
gactcacccgttattacttcagt

SEQ ID NO: 18121 - DNA, 23 bp, Artificial Sequence
  Synthetic construct
gactcacccgttattacgacagt

SEQ ID NO: 18122 - DNA, 23 bp, Artificial Sequence
  Synthetic construct
gactcacccgttattacgccagt

SEQ ID NO: 18123 - DNA, 23 bp, Artificial Sequence
  Synthetic construct
gactcacccgttattacggcagt

SEQ ID NO: 18124 - DNA, 23 bp, Artificial Sequence
  Synthetic construct
gactcacccgttattacgtaagt

SEQ ID NO: 18125 - DNA, 23 bp, Artificial Sequence
  Synthetic construct
gactcacccgttattacgtgagt

SEQ ID NO: 18126 - DNA, 23 bp, Artificial Sequence
  Synthetic construct
gactcacccgttattacgttagt

SEQ ID NO: 18127 - DNA, 23 bp, Artificial Sequence
  Synthetic construct
gactcacccgttattacgtccgt

SEQ ID NO: 18128 - DNA, 23 bp, Artificial Sequence
  Synthetic construct
gactcacccgttattacgtcggt

SEQ ID NO: 18129 - DNA, 23 bp, Artificial Sequence
  Synthetic construct
gactcacccgttattacgtctgt

SEQ ID NO: 18130 - DNA, 23 bp, Artificial Sequence
  Synthetic construct
gactcacccgttattacgtcaat

SEQ ID NO: 18131 - DNA, 23 bp, Artificial Sequence
  Synthetic construct
gactcacccgttattacgtcact

SEQ ID NO: 18132 - DNA, 23 bp, Artificial Sequence
  Synthetic construct
gactcacccgttattacgtcatt

SEQ ID NO: 18133 - DNA, 23 bp, Artificial Sequence
  Synthetic construct
gactcacccgttattacgtcaga

SEQ ID NO: 18134 - DNA, 23 bp, Artificial Sequence
  Synthetic construct
gactcacccgttattacgtcagc

SEQ ID NO: 18135 - DNA, 23 bp, Artificial Sequence
  Synthetic construct
gactcacccgttattacgtcagg

SEQ ID NO: 18136 - DNA, 21 bp, Artificial Sequence
  Synthetic construct
aaggctccttacaggcagccc

SEQ ID NO: 18137 - DNA, 21 bp, Artificial Sequence
  Synthetic construct
gaggctccttacaggcagccc

SEQ ID NO: 18138 - DNA, 21 bp, Artificial Sequence
  Synthetic construct
taggctccttacaggcagccc

SEQ ID NO: 18139 - DNA, 21 bp, Artificial Sequence
  Synthetic construct
ccggctccttacaggcagccc

SEQ ID NO: 18140 - DNA, 21 bp, Artificial Sequence
  Synthetic construct
cgggctccttacaggcagccc

SEQ ID NO: 18141 - DNA, 21 bp, Artificial Sequence
  Synthetic construct
ctggctccttacaggcagccc

SEQ ID NO: 18142 - DNA, 21 bp, Artificial Sequence
  Synthetic construct
caagctccttacaggcagccc

SEQ ID NO: 18143 - DNA, 21 bp, Artificial Sequence
  Synthetic construct
cacgctccttacaggcagccc

SEQ ID NO: 18144 - DNA, 21 bp, Artificial Sequence
  Synthetic construct
catgctccttacaggcagccc

SEQ ID NO: 18145 - DNA, 21 bp, Artificial Sequence
  Synthetic construct
cagactccttacaggcagccc

SEQ ID NO: 18146 - DNA, 21 bp, Artificial Sequence
  Synthetic construct
cagcctccttacaggcagccc

SEQ ID NO: 18147 - DNA, 21 bp, Artificial Sequence
  Synthetic construct
cagtctccttacaggcagccc

SEQ ID NO: 18148 - DNA, 21 bp, Artificial Sequence
  Synthetic construct
caggatccttacaggcagccc

SEQ ID NO: 18149 - DNA, 21 bp, Artificial Sequence
  Synthetic construct
cagggtccttacaggcagccc

SEQ ID NO: 18150 - DNA, 21 bp, Artificial Sequence
  Synthetic construct
caggttccttacaggcagccc

SEQ ID NO: 18151 - DNA, 21 bp, Artificial Sequence
  Synthetic construct
caggcaccttacaggcagccc

SEQ ID NO: 18152 - DNA, 21 bp, Artificial Sequence
  Synthetic construct
caggccccttacaggcagccc

SEQ ID NO: 18153 - DNA, 21 bp, Artificial Sequence
  Synthetic construct
caggcgccttacaggcagccc

SEQ ID NO: 18154 - DNA, 21 bp, Artificial Sequence
  Synthetic construct
caggctacttacaggcagccc

SEQ ID NO: 18155 - DNA, 21 bp, Artificial Sequence
  Synthetic construct
caggctgcttacaggcagccc

SEQ ID NO: 18156 - DNA, 21 bp, Artificial Sequence
  Synthetic construct
caggcttcttacaggcagccc

SEQ ID NO: 18157 - DNA, 21 bp, Artificial Sequence
  Synthetic construct
caggctcattacaggcagccc

SEQ ID NO: 18158 - DNA, 21 bp, Artificial Sequence
  Synthetic construct
caggctcgttacaggcagccc

SEQ ID NO: 18159 - DNA, 21 bp, Artificial Sequence
  Synthetic construct
caggctctttacaggcagccc

SEQ ID NO: 18160 - DNA, 21 bp, Artificial Sequence
  Synthetic construct
caggctccatacaggcagccc

SEQ ID NO: 18161 - DNA, 21 bp, Artificial Sequence
  Synthetic construct
caggctccctacaggcagccc

SEQ ID NO: 18162 - DNA, 21 bp, Artificial Sequence
  Synthetic construct
caggctccgtacaggcagccc

SEQ ID NO: 18163 - DNA, 21 bp, Artificial Sequence
  Synthetic construct
caggctcctaacaggcagccc

SEQ ID NO: 18164 - DNA, 21 bp, Artificial Sequence
  Synthetic construct
caggctcctcacaggcagccc

SEQ ID NO: 18165 - DNA, 21 bp, Artificial Sequence
  Synthetic construct
caggctcctgacaggcagccc

SEQ ID NO: 18166 - DNA, 21 bp, Artificial Sequence
  Synthetic construct
caggctccttccaggcagccc

SEQ ID NO: 18167 - DNA, 21 bp, Artificial Sequence
  Synthetic construct
caggctccttgcaggcagccc

SEQ ID NO: 18168 - DNA, 21 bp, Artificial Sequence
  Synthetic construct
caggctcctttcaggcagccc

SEQ ID NO: 18169 - DNA, 21 bp, Artificial Sequence
  Synthetic construct
caggctccttaaaggcagccc

SEQ ID NO: 18170 - DNA, 21 bp, Artificial Sequence
  Synthetic construct
caggctccttagaggcagccc

SEQ ID NO: 18171 - DNA, 21 bp, Artificial Sequence
  Synthetic construct
caggctccttataggcagccc

SEQ ID NO: 18172 - DNA, 21 bp, Artificial Sequence
  Synthetic construct
caggctccttaccggcagccc

SEQ ID NO: 18173 - DNA, 21 bp, Artificial Sequence
  Synthetic construct
caggctccttacgggcagccc

SEQ ID NO: 18174 - DNA, 21 bp, Artificial Sequence
  Synthetic construct
caggctccttactggcagccc

SEQ ID NO: 18175 - DNA, 21 bp, Artificial Sequence
  Synthetic construct
caggctccttacaagcagccc

SEQ ID NO: 18176 - DNA, 21 bp, Artificial Sequence
  Synthetic construct
caggctccttacacgcagccc

SEQ ID NO: 18177 - DNA, 21 bp, Artificial Sequence
  Synthetic construct
caggctccttacatgcagccc

SEQ ID NO: 18178 - DNA, 21 bp, Artificial Sequence
  Synthetic construct
caggctccttacagacagccc

SEQ ID NO: 18179 - DNA, 21 bp, Artificial Sequence
  Synthetic construct
caggctccttacagccagccc

SEQ ID NO: 18180 - DNA, 21 bp, Artificial Sequence
  Synthetic construct
caggctccttacagtcagccc

SEQ ID NO: 18181 - DNA, 21 bp, Artificial Sequence
  Synthetic construct
caggctccttacaggaagccc

SEQ ID NO: 18182 - DNA, 21 bp, Artificial Sequence
  Synthetic construct
caggctccttacagggagccc

SEQ ID NO: 18183 - DNA, 21 bp, Artificial Sequence
  Synthetic construct
caggctccttacaggtagccc

SEQ ID NO: 18184 - DNA, 21 bp, Artificial Sequence
  Synthetic construct
caggctccttacaggccgccc

SEQ ID NO: 18185 - DNA, 21 bp, Artificial Sequence
  Synthetic construct
caggctccttacaggcggccc

SEQ ID NO: 18186 - DNA, 21 bp, Artificial Sequence
  Synthetic construct
caggctccttacaggctgccc

SEQ ID NO: 18187 - DNA, 21 bp, Artificial Sequence
  Synthetic construct
caggctccttacaggcaaccc

SEQ ID NO: 18188 - DNA, 21 bp, Artificial Sequence
  Synthetic construct
caggctccttacaggcacccc

SEQ ID NO: 18189 - DNA, 21 bp, Artificial Sequence
  Synthetic construct
caggctccttacaggcatccc

SEQ ID NO: 18190 - DNA, 21 bp, Artificial Sequence
  Synthetic construct
caggctccttacaggcagacc

SEQ ID NO: 18191 - DNA, 21 bp, Artificial Sequence
  Synthetic construct
caggctccttacaggcaggcc

SEQ ID NO: 18192 - DNA, 21 bp, Artificial Sequence
  Synthetic construct
caggctccttacaggcagtcc

SEQ ID NO: 18193 - DNA, 21 bp, Artificial Sequence
  Synthetic construct
caggctccttacaggcagcac

SEQ ID NO: 18194 - DNA, 21 bp, Artificial Sequence
  Synthetic construct
caggctccttacaggcagcgc

SEQ ID NO: 18195 - DNA, 21 bp, Artificial Sequence
  Synthetic construct
caggctccttacaggcagctc

SEQ ID NO: 18196 - DNA, 21 bp, Artificial Sequence
  Synthetic construct
caggctccttacaggcagcca

SEQ ID NO: 18197 - DNA, 21 bp, Artificial Sequence
  Synthetic construct
caggctccttacaggcagccg

SEQ ID NO: 18198 - DNA, 21 bp, Artificial Sequence
  Synthetic construct
caggctccttacaggcagcct

SEQ ID NO: 18199 - DNA, 21 bp, Artificial Sequence
  Synthetic construct
atgagcaggaccccgaaaggg

SEQ ID NO: 18200 - DNA, 21 bp, Artificial Sequence
  Synthetic construct
ctgagcaggaccccgaaaggg

SEQ ID NO: 18201 - DNA, 21 bp, Artificial Sequence
  Synthetic construct
gtgagcaggaccccgaaaggg

SEQ ID NO: 18202 - DNA, 21 bp, Artificial Sequence
  Synthetic construct
tagagcaggaccccgaaaggg

SEQ ID NO: 18203 - DNA, 21 bp, Artificial Sequence
  Synthetic construct
tcgagcaggaccccgaaaggg

SEQ ID NO: 18204 - DNA, 21 bp, Artificial Sequence
  Synthetic construct
tggagcaggaccccgaaaggg

SEQ ID NO: 18205 - DNA, 21 bp, Artificial Sequence
  Synthetic construct
ttaagcaggaccccgaaaggg

SEQ ID NO: 18206 - DNA, 21 bp, Artificial Sequence
  Synthetic construct
ttcagcaggaccccgaaaggg

SEQ ID NO: 18207 - DNA, 21 bp, Artificial Sequence
  Synthetic construct
tttagcaggaccccgaaaggg

SEQ ID NO: 18208 - DNA, 21 bp, Artificial Sequence
  Synthetic construct
ttgcgcaggaccccgaaaggg

SEQ ID NO: 18209 - DNA, 21 bp, Artificial Sequence
  Synthetic construct
ttgggcaggaccccgaaaggg

SEQ ID NO: 18210 - DNA, 21 bp, Artificial Sequence
  Synthetic construct
ttgtgcaggaccccgaaaggg

SEQ ID NO: 18211 - DNA, 21 bp, Artificial Sequence
  Synthetic construct
ttgaacaggaccccgaaaggg

SEQ ID NO: 18212 - DNA, 21 bp, Artificial Sequence
  Synthetic construct
ttgaccaggaccccgaaaggg

SEQ ID NO: 18213 - DNA, 21 bp, Artificial Sequence
  Synthetic construct
ttgatcaggaccccgaaaggg

SEQ ID NO: 18214 - DNA, 21 bp, Artificial Sequence
  Synthetic construct
ttgagaaggaccccgaaaggg

SEQ ID NO: 18215 - DNA, 21 bp, Artificial Sequence
  Synthetic construct
ttgaggaggaccccgaaaggg

SEQ ID NO: 18216 - DNA, 21 bp, Artificial Sequence
  Synthetic construct
ttgagtaggaccccgaaaggg

SEQ ID NO: 18217 - DNA, 21 bp, Artificial Sequence
  Synthetic construct
ttgagccggaccccgaaaggg

SEQ ID NO: 18218 - DNA, 21 bp, Artificial Sequence
  Synthetic construct
ttgagcgggaccccgaaaggg

SEQ ID NO: 18219 - DNA, 21 bp, Artificial Sequence
  Synthetic construct
ttgagctggaccccgaaaggg

SEQ ID NO: 18220 - DNA, 21 bp, Artificial Sequence
  Synthetic construct
ttgagcaagaccccgaaaggg

SEQ ID NO: 18221 - DNA, 21 bp, Artificial Sequence
  Synthetic construct
ttgagcacgaccccgaaaggg

SEQ ID NO: 18222 - DNA, 21 bp, Artificial Sequence
  Synthetic construct
ttgagcatgaccccgaaaggg

SEQ ID NO: 18223 - DNA, 21 bp, Artificial Sequence
  Synthetic construct
ttgagcagaaccccgaaaggg

SEQ ID NO: 18224 - DNA, 21 bp, Artificial Sequence
  Synthetic construct
ttgagcagcaccccgaaaggg

SEQ ID NO: 18225 - DNA, 21 bp, Artificial Sequence
  Synthetic construct
ttgagcagtaccccgaaaggg

SEQ ID NO: 18226 - DNA, 21 bp, Artificial Sequence
  Synthetic construct
ttgagcaggcccccgaaaggg

SEQ ID NO: 18227 - DNA, 21 bp, Artificial Sequence
  Synthetic construct
ttgagcagggccccgaaaggg

SEQ ID NO: 18228 - DNA, 21 bp, Artificial Sequence
  Synthetic construct
ttgagcaggtccccgaaaggg

SEQ ID NO: 18229 - DNA, 21 bp, Artificial Sequence
  Synthetic construct
ttgagcaggaacccgaaaggg

SEQ ID NO: 18230 - DNA, 21 bp, Artificial Sequence
  Synthetic construct
ttgagcaggagcccgaaaggg

SEQ ID NO: 18231 - DNA, 21 bp, Artificial Sequence
  Synthetic construct
ttgagcaggatcccgaaaggg

SEQ ID NO: 18232 - DNA, 21 bp, Artificial Sequence
  Synthetic construct
ttgagcaggacaccgaaaggg

SEQ ID NO: 18233 - DNA, 21 bp, Artificial Sequence
  Synthetic construct
ttgagcaggacgccgaaaggg

SEQ ID NO: 18234 - DNA, 21 bp, Artificial Sequence
  Synthetic construct
ttgagcaggactccgaaaggg

SEQ ID NO: 18235 - DNA, 21 bp, Artificial Sequence
  Synthetic construct
ttgagcaggaccacgaaaggg

SEQ ID NO: 18236 - DNA, 21 bp, Artificial Sequence
  Synthetic construct
ttgagcaggaccgcgaaaggg

SEQ ID NO: 18237 - DNA, 21 bp, Artificial Sequence
  Synthetic construct
ttgagcaggacctcgaaaggg

SEQ ID NO: 18238 - DNA, 21 bp, Artificial Sequence
  Synthetic construct
ttgagcaggacccagaaaggg

SEQ ID NO: 18239 - DNA, 21 bp, Artificial Sequence
  Synthetic construct
ttgagcaggacccggaaaggg

SEQ ID NO: 18240 - DNA, 21 bp, Artificial Sequence
  Synthetic construct
ttgagcaggaccctgaaaggg

SEQ ID NO: 18241 - DNA, 21 bp, Artificial Sequence
  Synthetic construct
ttgagcaggaccccaaaaggg

SEQ ID NO: 18242 - DNA, 21 bp, Artificial Sequence
  Synthetic construct
ttgagcaggacccccaaaggg

SEQ ID NO: 18243 - DNA, 21 bp, Artificial Sequence
  Synthetic construct
ttgagcaggacccctaaaggg

SEQ ID NO: 18244 - DNA, 21 bp, Artificial Sequence
  Synthetic construct
ttgagcaggaccccgcaaggg

SEQ ID NO: 18245 - DNA, 21 bp, Artificial Sequence
  Synthetic construct
ttgagcaggaccccggaaggg

SEQ ID NO: 18246 - DNA, 21 bp, Artificial Sequence
  Synthetic construct
ttgagcaggaccccgtaaggg

SEQ ID NO: 18247 - DNA, 21 bp, Artificial Sequence
  Synthetic construct
ttgagcaggaccccgacaggg

SEQ ID NO: 18248 - DNA, 21 bp, Artificial Sequence
  Synthetic construct
ttgagcaggaccccgagaggg

SEQ ID NO: 18249 - DNA, 21 bp, Artificial Sequence
  Synthetic construct
ttgagcaggaccccgataggg

SEQ ID NO: 18250 - DNA, 21 bp, Artificial Sequence
  Synthetic construct
ttgagcaggaccccgaacggg

SEQ ID NO: 18251 - DNA, 21 bp, Artificial Sequence
  Synthetic construct
ttgagcaggaccccgaagggg

SEQ ID NO: 18252 - DNA, 21 bp, Artificial Sequence
  Synthetic construct
ttgagcaggaccccgaatggg

SEQ ID NO: 18253 - DNA, 21 bp, Artificial Sequence
  Synthetic construct
ttgagcaggaccccgaaaagg

SEQ ID NO: 18254 - DNA, 21 bp, Artificial Sequence
  Synthetic construct
ttgagcaggaccccgaaacgg

SEQ ID NO: 18255 - DNA, 21 bp, Artificial Sequence
  Synthetic construct
ttgagcaggaccccgaaatgg

SEQ ID NO: 18256 - DNA, 21 bp, Artificial Sequence
  Synthetic construct
ttgagcaggaccccgaaagag

SEQ ID NO: 18257 - DNA, 21 bp, Artificial Sequence
  Synthetic construct
ttgagcaggaccccgaaagcg

SEQ ID NO: 18258 - DNA, 21 bp, Artificial Sequence
  Synthetic construct
ttgagcaggaccccgaaagtg

SEQ ID NO: 18259 - DNA, 21 bp, Artificial Sequence
  Synthetic construct
ttgagcaggaccccgaaagga

SEQ ID NO: 18260 - DNA, 21 bp, Artificial Sequence
  Synthetic construct
ttgagcaggaccccgaaaggc

SEQ ID NO: 18261 - DNA, 21 bp, Artificial Sequence
  Synthetic construct
ttgagcaggaccccgaaaggt

SEQ ID NO: 18262 - DNA, 20 bp, Artificial Sequence
  Synthetic construct
aagtatggaaccacgctatg

SEQ ID NO: 18263 - DNA, 20 bp, Artificial Sequence
  Synthetic construct
gagtatggaaccacgctatg

SEQ ID NO: 18264 - DNA, 20 bp, Artificial Sequence
  Synthetic construct
tagtatggaaccacgctatg

SEQ ID NO: 18265 - DNA, 20 bp, Artificial Sequence
  Synthetic construct
ccgtatggaaccacgctatg

SEQ ID NO: 18266 - DNA, 20 bp, Artificial Sequence
  Synthetic construct
cggtatggaaccacgctatg

SEQ ID NO: 18267 - DNA, 20 bp, Artificial Sequence
  Synthetic construct
ctgtatggaaccacgctatg

SEQ ID NO: 18268 - DNA, 20 bp, Artificial Sequence
  Synthetic construct
caatatggaaccacgctatg

SEQ ID NO: 18269 - DNA, 20 bp, Artificial Sequence
  Synthetic construct
cactatggaaccacgctatg

SEQ ID NO: 18270 - DNA, 20 bp, Artificial Sequence
  Synthetic construct
cattatggaaccacgctatg

SEQ ID NO: 18271 - DNA, 20 bp, Artificial Sequence
  Synthetic construct
cagaatggaaccacgctatg

SEQ ID NO: 18272 - DNA, 20 bp, Artificial Sequence
  Synthetic construct
cagcatggaaccacgctatg

SEQ ID NO: 18273 - DNA, 20 bp, Artificial Sequence
  Synthetic construct
caggatggaaccacgctatg

SEQ ID NO: 18274 - DNA, 20 bp, Artificial Sequence
  Synthetic construct
cagtctggaaccacgctatg

SEQ ID NO: 18275 - DNA, 20 bp, Artificial Sequence
  Synthetic construct
cagtgtggaaccacgctatg

SEQ ID NO: 18276 - DNA, 20 bp, Artificial Sequence
  Synthetic construct
cagtttggaaccacgctatg

SEQ ID NO: 18277 - DNA, 20 bp, Artificial Sequence
  Synthetic construct
cagtaaggaaccacgctatg

SEQ ID NO: 18278 - DNA, 20 bp, Artificial Sequence
  Synthetic construct
cagtacggaaccacgctatg

SEQ ID NO: 18279 - DNA, 20 bp, Artificial Sequence
  Synthetic construct
cagtagggaaccacgctatg

SEQ ID NO: 18280 - DNA, 20 bp, Artificial Sequence
  Synthetic construct
cagtatagaaccacgctatg

SEQ ID NO: 18281 - DNA, 20 bp, Artificial Sequence
  Synthetic construct
cagtatcgaaccacgctatg

SEQ ID NO: 18282 - DNA, 20 bp, Artificial Sequence
  Synthetic construct
cagtattgaaccacgctatg

SEQ ID NO: 18283 - DNA, 20 bp, Artificial Sequence
  Synthetic construct
cagtatgaaaccacgctatg

SEQ ID NO: 18284 - DNA, 20 bp, Artificial Sequence
  Synthetic construct
cagtatgcaaccacgctatg

SEQ ID NO: 18285 - DNA, 20 bp, Artificial Sequence
  Synthetic construct
cagtatgtaaccacgctatg

SEQ ID NO: 18286 - DNA, 20 bp, Artificial Sequence
  Synthetic construct
cagtatggcaccacgctatg

SEQ ID NO: 18287 - DNA, 20 bp, Artificial Sequence
  Synthetic construct
cagtatgggaccacgctatg

SEQ ID NO: 18288 - DNA, 20 bp, Artificial Sequence
  Synthetic construct
cagtatggtaccacgctatg

SEQ ID NO: 18289 - DNA, 20 bp, Artificial Sequence
  Synthetic construct
cagtatggacccacgctatg

SEQ ID NO: 18290 - DNA, 20 bp, Artificial Sequence
  Synthetic construct
cagtatggagccacgctatg

SEQ ID NO: 18291 - DNA, 20 bp, Artificial Sequence
  Synthetic construct
cagtatggatccacgctatg

SEQ ID NO: 18292 - DNA, 20 bp, Artificial Sequence
  Synthetic construct
cagtatggaaacacgctatg

SEQ ID NO: 18293 - DNA, 20 bp, Artificial Sequence
  Synthetic construct
cagtatggaagcacgctatg

SEQ ID NO: 18294 - DNA, 20 bp, Artificial Sequence
  Synthetic construct
cagtatggaatcacgctatg

SEQ ID NO: 18295 - DNA, 20 bp, Artificial Sequence
  Synthetic construct
cagtatggaacaacgctatg

SEQ ID NO: 18296 - DNA, 20 bp, Artificial Sequence
  Synthetic construct
cagtatggaacgacgctatg

SEQ ID NO: 18297 - DNA, 20 bp, Artificial Sequence
  Synthetic construct
cagtatggaactacgctatg

SEQ ID NO: 18298 - DNA, 20 bp, Artificial Sequence
  Synthetic construct
cagtatggaaccccgctatg

SEQ ID NO: 18299 - DNA, 20 bp, Artificial Sequence
  Synthetic construct
cagtatggaaccgcgctatg

SEQ ID NO: 18300 - DNA, 20 bp, Artificial Sequence
  Synthetic construct
cagtatggaacctcgctatg

SEQ ID NO: 18301 - DNA, 20 bp, Artificial Sequence
  Synthetic construct
cagtatggaaccaagctatg

SEQ ID NO: 18302 - DNA, 20 bp, Artificial Sequence
  Synthetic construct
cagtatggaaccaggctatg

SEQ ID NO: 18303 - DNA, 20 bp, Artificial Sequence
  Synthetic construct
cagtatggaaccatgctatg

SEQ ID NO: 18304 - DNA, 20 bp, Artificial Sequence
  Synthetic construct
cagtatggaaccacactatg

SEQ ID NO: 18305 - DNA, 20 bp, Artificial Sequence
  Synthetic construct
cagtatggaaccaccctatg

SEQ ID NO: 18306 - DNA, 20 bp, Artificial Sequence
  Synthetic construct
cagtatggaaccactctatg

SEQ ID NO: 18307 - DNA, 20 bp, Artificial Sequence
  Synthetic construct
cagtatggaaccacgatatg

SEQ ID NO: 18308 - DNA, 20 bp, Artificial Sequence
  Synthetic construct
cagtatggaaccacggtatg

SEQ ID NO: 18309 - DNA, 20 bp, Artificial Sequence
  Synthetic construct
cagtatggaaccacgttatg

SEQ ID NO: 18310 - DNA, 20 bp, Artificial Sequence
  Synthetic construct
cagtatggaaccacgcaatg

SEQ ID NO: 18311 - DNA, 20 bp, Artificial Sequence
  Synthetic construct
cagtatggaaccacgccatg

SEQ ID NO: 18312 - DNA, 20 bp, Artificial Sequence
  Synthetic construct
cagtatggaaccacgcgatg

SEQ ID NO: 18313 - DNA, 20 bp, Artificial Sequence
  Synthetic construct
cagtatggaaccacgctctg

SEQ ID NO: 18314 - DNA, 20 bp, Artificial Sequence
  Synthetic construct
cagtatggaaccacgctgtg

SEQ ID NO: 18315 - DNA, 20 bp, Artificial Sequence
  Synthetic construct
cagtatggaaccacgctttg

SEQ ID NO: 18316 - DNA, 20 bp, Artificial Sequence
  Synthetic construct
cagtatggaaccacgctaag

SEQ ID NO: 18317 - DNA, 20 bp, Artificial Sequence
  Synthetic construct
cagtatggaaccacgctacg

SEQ ID NO: 18318 - DNA, 20 bp, Artificial Sequence
  Synthetic construct
cagtatggaaccacgctagg

SEQ ID NO: 18319 - DNA, 20 bp, Artificial Sequence
  Synthetic construct
cagtatggaaccacgctata

SEQ ID NO: 18320 - DNA, 20 bp, Artificial Sequence
  Synthetic construct
cagtatggaaccacgctatc

SEQ ID NO: 18321 - DNA, 20 bp, Artificial Sequence
  Synthetic construct
cagtatggaaccacgctatt

SEQ ID NO: 18322 - DNA, 21 bp, Artificial Sequence
  Synthetic construct
aaagagattgtcaacaggttt

SEQ ID NO: 18323 - DNA, 21 bp, Artificial Sequence
  Synthetic construct
caagagattgtcaacaggttt

SEQ ID NO: 18324 - DNA, 21 bp, Artificial Sequence
  Synthetic construct
taagagattgtcaacaggttt

SEQ ID NO: 18325 - DNA, 21 bp, Artificial Sequence
  Synthetic construct
gcagagattgtcaacaggttt

SEQ ID NO: 18326 - DNA, 21 bp, Artificial Sequence
  Synthetic construct
ggagagattgtcaacaggttt

SEQ ID NO: 18327 - DNA, 21 bp, Artificial Sequence
  Synthetic construct
gtagagattgtcaacaggttt

SEQ ID NO: 18328 - DNA, 21 bp, Artificial Sequence
  Synthetic construct
gacgagattgtcaacaggttt

SEQ ID NO: 18329 - DNA, 21 bp, Artificial Sequence
  Synthetic construct
gaggagattgtcaacaggttt

SEQ ID NO: 18330 - DNA, 21 bp, Artificial Sequence
  Synthetic construct
gatgagattgtcaacaggttt

SEQ ID NO: 18331 - DNA, 21 bp, Artificial Sequence
  Synthetic construct
gaaaagattgtcaacaggttt

SEQ ID NO: 18332 - DNA, 21 bp, Artificial Sequence
  Synthetic construct
gaacagattgtcaacaggttt

SEQ ID NO: 18333 - DNA, 21 bp, Artificial Sequence
  Synthetic construct
gaatagattgtcaacaggttt

SEQ ID NO: 18334 - DNA, 21 bp, Artificial Sequence
  Synthetic construct
gaagcgattgtcaacaggttt

SEQ ID NO: 18335 - DNA, 21 bp, Artificial Sequence
  Synthetic construct
gaagggattgtcaacaggttt

SEQ ID NO: 18336 - DNA, 21 bp, Artificial Sequence
  Synthetic construct
gaagtgattgtcaacaggttt

SEQ ID NO: 18337 - DNA, 21 bp, Artificial Sequence
  Synthetic construct
gaagaaattgtcaacaggttt

SEQ ID NO: 18338 - DNA, 21 bp, Artificial Sequence
  Synthetic construct
gaagacattgtcaacaggttt

SEQ ID NO: 18339 - DNA, 21 bp, Artificial Sequence
  Synthetic construct
gaagatattgtcaacaggttt

SEQ ID NO: 18340 - DNA, 21 bp, Artificial Sequence
  Synthetic construct
gaagagcttgtcaacaggttt

SEQ ID NO: 18341 - DNA, 21 bp, Artificial Sequence
  Synthetic construct
gaagaggttgtcaacaggttt

SEQ ID NO: 18342 - DNA, 21 bp, Artificial Sequence
  Synthetic construct
gaagagtttgtcaacaggttt

SEQ ID NO: 18343 - DNA, 21 bp, Artificial Sequence
  Synthetic construct
gaagagaatgtcaacaggttt

SEQ ID NO: 18344 - DNA, 21 bp, Artificial Sequence
  Synthetic construct
gaagagactgtcaacaggttt

SEQ ID NO: 18345 - DNA, 21 bp, Artificial Sequence
  Synthetic construct
gaagagagtgtcaacaggttt

SEQ ID NO: 18346 - DNA, 21 bp, Artificial Sequence
  Synthetic construct
gaagagatagtcaacaggttt

SEQ ID NO: 18347 - DNA, 21 bp, Artificial Sequence
  Synthetic construct
gaagagatcgtcaacaggttt

SEQ ID NO: 18348 - DNA, 21 bp, Artificial Sequence
  Synthetic construct
gaagagatggtcaacaggttt

SEQ ID NO: 18349 - DNA, 21 bp, Artificial Sequence
  Synthetic construct
gaagagattatcaacaggttt

SEQ ID NO: 18350 - DNA, 21 bp, Artificial Sequence
  Synthetic construct
gaagagattctcaacaggttt

SEQ ID NO: 18351 - DNA, 21 bp, Artificial Sequence
  Synthetic construct
gaagagattttcaacaggttt

SEQ ID NO: 18352 - DNA, 21 bp, Artificial Sequence
  Synthetic construct
gaagagattgacaacaggttt

SEQ ID NO: 18353 - DNA, 21 bp, Artificial Sequence
  Synthetic construct
gaagagattgccaacaggttt

SEQ ID NO: 18354 - DNA, 21 bp, Artificial Sequence
  Synthetic construct
gaagagattggcaacaggttt

SEQ ID NO: 18355 - DNA, 21 bp, Artificial Sequence
  Synthetic construct
gaagagattgtaaacaggttt

SEQ ID NO: 18356 - DNA, 21 bp, Artificial Sequence
  Synthetic construct
gaagagattgtgaacaggttt

SEQ ID NO: 18357 - DNA, 21 bp, Artificial Sequence
  Synthetic construct
gaagagattgttaacaggttt

SEQ ID NO: 18358 - DNA, 21 bp, Artificial Sequence
  Synthetic construct
gaagagattgtccacaggttt

SEQ ID NO: 18359 - DNA, 21 bp, Artificial Sequence
  Synthetic construct
gaagagattgtcgacaggttt

SEQ ID NO: 18360 - DNA, 21 bp, Artificial Sequence
  Synthetic construct
gaagagattgtctacaggttt

SEQ ID NO: 18361 - DNA, 21 bp, Artificial Sequence
  Synthetic construct
gaagagattgtcaccaggttt

SEQ ID NO: 18362 - DNA, 21 bp, Artificial Sequence
  Synthetic construct
gaagagattgtcagcaggttt

SEQ ID NO: 18363 - DNA, 21 bp, Artificial Sequence
  Synthetic construct
gaagagattgtcatcaggttt

SEQ ID NO: 18364 - DNA, 21 bp, Artificial Sequence
  Synthetic construct
gaagagattgtcaaaaggttt

SEQ ID NO: 18365 - DNA, 21 bp, Artificial Sequence
  Synthetic construct
gaagagattgtcaagaggttt

SEQ ID NO: 18366 - DNA, 21 bp, Artificial Sequence
  Synthetic construct
gaagagattgtcaataggttt

SEQ ID NO: 18367 - DNA, 21 bp, Artificial Sequence
  Synthetic construct
gaagagattgtcaaccggttt

SEQ ID NO: 18368 - DNA, 21 bp, Artificial Sequence
  Synthetic construct
gaagagattgtcaacgggttt

SEQ ID NO: 18369 - DNA, 21 bp, Artificial Sequence
  Synthetic construct
gaagagattgtcaactggttt

SEQ ID NO: 18370 - DNA, 21 bp, Artificial Sequence
  Synthetic construct
gaagagattgtcaacaagttt

SEQ ID NO: 18371 - DNA, 21 bp, Artificial Sequence
  Synthetic construct
gaagagattgtcaacacgttt

SEQ ID NO: 18372 - DNA, 21 bp, Artificial Sequence
  Synthetic construct
gaagagattgtcaacatgttt

SEQ ID NO: 18373 - DNA, 21 bp, Artificial Sequence
  Synthetic construct
gaagagattgtcaacagattt

SEQ ID NO: 18374 - DNA, 21 bp, Artificial Sequence
  Synthetic construct
gaagagattgtcaacagcttt

SEQ ID NO: 18375 - DNA, 21 bp, Artificial Sequence
  Synthetic construct
gaagagattgtcaacagtttt

SEQ ID NO: 18376 - DNA, 21 bp, Artificial Sequence
  Synthetic construct
gaagagattgtcaacaggatt

SEQ ID NO: 18377 - DNA, 21 bp, Artificial Sequence
  Synthetic construct
gaagagattgtcaacaggctt

SEQ ID NO: 18378 - DNA, 21 bp, Artificial Sequence
  Synthetic construct
gaagagattgtcaacagggtt

SEQ ID NO: 18379 - DNA, 21 bp, Artificial Sequence
  Synthetic construct
gaagagattgtcaacaggtat

SEQ ID NO: 18380 - DNA, 21 bp, Artificial Sequence
  Synthetic construct
gaagagattgtcaacaggtct

SEQ ID NO: 18381 - DNA, 21 bp, Artificial Sequence
  Synthetic construct
gaagagattgtcaacaggtgt

SEQ ID NO: 18382 - DNA, 21 bp, Artificial Sequence
  Synthetic construct
gaagagattgtcaacaggtta

SEQ ID NO: 18383 - DNA, 21 bp, Artificial Sequence
  Synthetic construct
gaagagattgtcaacaggttc

SEQ ID NO: 18384 - DNA, 21 bp, Artificial Sequence
  Synthetic construct
gaagagattgtcaacaggttg

SEQ ID NO: 18385 - DNA, 21 bp, Artificial Sequence
  Synthetic construct
aagccatggtagcgtctcgct

SEQ ID NO: 18386 - DNA, 21 bp, Artificial Sequence
  Synthetic construct
cagccatggtagcgtctcgct

SEQ ID NO: 18387 - DNA, 21 bp, Artificial Sequence
  Synthetic construct
gagccatggtagcgtctcgct

SEQ ID NO: 18388 - DNA, 21 bp, Artificial Sequence
  Synthetic construct
tcgccatggtagcgtctcgct

SEQ ID NO: 18389 - DNA, 21 bp, Artificial Sequence
  Synthetic construct
tggccatggtagcgtctcgct

SEQ ID NO: 18390 - DNA, 21 bp, Artificial Sequence
  Synthetic construct
ttgccatggtagcgtctcgct

SEQ ID NO: 18391 - DNA, 21 bp, Artificial Sequence
  Synthetic construct
taaccatggtagcgtctcgct

SEQ ID NO: 18392 - DNA, 21 bp, Artificial Sequence
  Synthetic construct
tacccatggtagcgtctcgct

SEQ ID NO: 18393 - DNA, 21 bp, Artificial Sequence
  Synthetic construct
tatccatggtagcgtctcgct

SEQ ID NO: 18394 - DNA, 21 bp, Artificial Sequence
  Synthetic construct
tagacatggtagcgtctcgct

SEQ ID NO: 18395 - DNA, 21 bp, Artificial Sequence
  Synthetic construct
taggcatggtagcgtctcgct

SEQ ID NO: 18396 - DNA, 21 bp, Artificial Sequence
  Synthetic construct
tagtcatggtagcgtctcgct

SEQ ID NO: 18397 - DNA, 21 bp, Artificial Sequence
  Synthetic construct
tagcaatggtagcgtctcgct

SEQ ID NO: 18398 - DNA, 21 bp, Artificial Sequence
  Synthetic construct
tagcgatggtagcgtctcgct

SEQ ID NO: 18399 - DNA, 21 bp, Artificial Sequence
  Synthetic construct
tagctatggtagcgtctcgct

SEQ ID NO: 18400 - DNA, 21 bp, Artificial Sequence
  Synthetic construct
tagccctggtagcgtctcgct

SEQ ID NO: 18401 - DNA, 21 bp, Artificial Sequence
  Synthetic construct
tagccgtggtagcgtctcgct

SEQ ID NO: 18402 - DNA, 21 bp, Artificial Sequence
  Synthetic construct
tagccttggtagcgtctcgct

SEQ ID NO: 18403 - DNA, 21 bp, Artificial Sequence
  Synthetic construct
tagccaaggtagcgtctcgct

SEQ ID NO: 18404 - DNA, 21 bp, Artificial Sequence
  Synthetic construct
tagccacggtagcgtctcgct

SEQ ID NO: 18405 - DNA, 21 bp, Artificial Sequence
  Synthetic construct
tagccagggtagcgtctcgct

SEQ ID NO: 18406 - DNA, 21 bp, Artificial Sequence
  Synthetic construct
tagccatagtagcgtctcgct

SEQ ID NO: 18407 - DNA, 21 bp, Artificial Sequence
  Synthetic construct
tagccatcgtagcgtctcgct

SEQ ID NO: 18408 - DNA, 21 bp, Artificial Sequence
  Synthetic construct
tagccattgtagcgtctcgct

SEQ ID NO: 18409 - DNA, 21 bp, Artificial Sequence
  Synthetic construct
tagccatgatagcgtctcgct

SEQ ID NO: 18410 - DNA, 21 bp, Artificial Sequence
  Synthetic construct
tagccatgctagcgtctcgct

SEQ ID NO: 18411 - DNA, 21 bp, Artificial Sequence
  Synthetic construct
tagccatgttagcgtctcgct

SEQ ID NO: 18412 - DNA, 21 bp, Artificial Sequence
  Synthetic construct
tagccatggaagcgtctcgct

SEQ ID NO: 18413 - DNA, 21 bp, Artificial Sequence
  Synthetic construct
tagccatggcagcgtctcgct

SEQ ID NO: 18414 - DNA, 21 bp, Artificial Sequence
  Synthetic construct
tagccatgggagcgtctcgct

SEQ ID NO: 18415 - DNA, 21 bp, Artificial Sequence
  Synthetic construct
tagccatggtcgcgtctcgct

SEQ ID NO: 18416 - DNA, 21 bp, Artificial Sequence
  Synthetic construct
tagccatggtggcgtctcgct

SEQ ID NO: 18417 - DNA, 21 bp, Artificial Sequence
  Synthetic construct
tagccatggttgcgtctcgct

SEQ ID NO: 18418 - DNA, 21 bp, Artificial Sequence
  Synthetic construct
tagccatggtaacgtctcgct

SEQ ID NO: 18419 - DNA, 21 bp, Artificial Sequence
  Synthetic construct
tagccatggtaccgtctcgct

SEQ ID NO: 18420 - DNA, 21 bp, Artificial Sequence
  Synthetic construct
tagccatggtatcgtctcgct

SEQ ID NO: 18421 - DNA, 21 bp, Artificial Sequence
  Synthetic construct
tagccatggtagagtctcgct

SEQ ID NO: 18422 - DNA, 21 bp, Artificial Sequence
  Synthetic construct
tagccatggtagggtctcgct

SEQ ID NO: 18423 - DNA, 21 bp, Artificial Sequence
  Synthetic construct
tagccatggtagtgtctcgct

SEQ ID NO: 18424 - DNA, 21 bp, Artificial Sequence
  Synthetic construct
tagccatggtagcatctcgct

SEQ ID NO: 18425 - DNA, 21 bp, Artificial Sequence
  Synthetic construct
tagccatggtagcctctcgct

SEQ ID NO: 18426 - DNA, 21 bp, Artificial Sequence
  Synthetic construct
tagccatggtagcttctcgct

SEQ ID NO: 18427 - DNA, 21 bp, Artificial Sequence
  Synthetic construct
tagccatggtagcgactcgct

SEQ ID NO: 18428 - DNA, 21 bp, Artificial Sequence
  Synthetic construct
tagccatggtagcgcctcgct

SEQ ID NO: 18429 - DNA, 21 bp, Artificial Sequence
  Synthetic construct
tagccatggtagcggctcgct

SEQ ID NO: 18430 - DNA, 21 bp, Artificial Sequence
  Synthetic construct
tagccatggtagcgtatcgct

SEQ ID NO: 18431 - DNA, 21 bp, Artificial Sequence
  Synthetic construct
tagccatggtagcgtgtcgct

SEQ ID NO: 18432 - DNA, 21 bp, Artificial Sequence
  Synthetic construct
tagccatggtagcgtttcgct

SEQ ID NO: 18433 - DNA, 21 bp, Artificial Sequence
  Synthetic construct
tagccatggtagcgtcacgct

SEQ ID NO: 18434 - DNA, 21 bp, Artificial Sequence
  Synthetic construct
tagccatggtagcgtcccgct

SEQ ID NO: 18435 - DNA, 21 bp, Artificial Sequence
  Synthetic construct
tagccatggtagcgtcgcgct

SEQ ID NO: 18436 - DNA, 21 bp, Artificial Sequence
  Synthetic construct
tagccatggtagcgtctagct

SEQ ID NO: 18437 - DNA, 21 bp, Artificial Sequence
  Synthetic construct
tagccatggtagcgtctggct

SEQ ID NO: 18438 - DNA, 21 bp, Artificial Sequence
  Synthetic construct
tagccatggtagcgtcttgct

SEQ ID NO: 18439 - DNA, 21 bp, Artificial Sequence
  Synthetic construct
tagccatggtagcgtctcact

SEQ ID NO: 18440 - DNA, 21 bp, Artificial Sequence
  Synthetic construct
tagccatggtagcgtctccct

SEQ ID NO: 18441 - DNA, 21 bp, Artificial Sequence
  Synthetic construct
tagccatggtagcgtctctct

SEQ ID NO: 18442 - DNA, 21 bp, Artificial Sequence
  Synthetic construct
tagccatggtagcgtctcgat

SEQ ID NO: 18443 - DNA, 21 bp, Artificial Sequence
  Synthetic construct
tagccatggtagcgtctcggt

SEQ ID NO: 18444 - DNA, 21 bp, Artificial Sequence
  Synthetic construct
tagccatggtagcgtctcgtt

SEQ ID NO: 18445 - DNA, 21 bp, Artificial Sequence
  Synthetic construct
tagccatggtagcgtctcgca

SEQ ID NO: 18446 - DNA, 21 bp, Artificial Sequence
  Synthetic construct
tagccatggtagcgtctcgcc

SEQ ID NO: 18447 - DNA, 21 bp, Artificial Sequence
  Synthetic construct
tagccatggtagcgtctcgcg

The invention claimed is:

1. A method of conducting a cleavage assay, the method comprising:
   incubating a synthetic guiding component with a nuclease and a single-stranded target sequence, the synthetic guiding component including a targeting portion configured to bind and/or cleave the single-stranded target sequence; and
   cleaving the single-stranded target sequence without a short DNA oligomer containing a proto-spacer adjacent motif (PAM) sequence (PAMmer);
   wherein the synthetic guiding component comprises a structure having the formula (I):

W—X—Y-L-Z or a salt thereof, wherein:

W is an optional third portion comprising a nucleic acid sequence of from about 1 to 20 nucleic acids;
   X is the targeting portion comprising a nucleic acid sequence configured to bind to a target site of the single-stranded target sequence;
   Y is a first portion comprising a nucleic acid sequence configured to interact with a nuclease configured to cleave the single-stranded target sequence;
   L is a linker; and
   Z is a second portion comprising a nucleic acid sequence configured to interact with the nuclease and the first portion;
   wherein the nuclease is a SauCas9 protein.

2. The method of claim 1, wherein:
   Y comprises a nucleic acid sequence having at least 80% sequence identity to any one of SEQ ID NOs:150-155 or a complement of any of these; and
   Z comprises a nucleic acid sequence having at least 80% sequence identity to any one of SEQ ID NOs:162-178 or a complement of any of these.

3. The method of claim 1, wherein:
   L comprises a bond or a nucleic acid sequence having at least 80% sequence identity to any one of SEQ ID NOs:156-161, 187-191, 226-231, and 265-269, or a complement of any of these.

4. The method of claim 1, wherein W and/or Y comprises one or more modified nucleic acids or bulges.

5. The method of claim 1, wherein the single stranded target sequence recited for X is a single-stranded human mRNA target sequence or a single-stranded pathogen target sequence.

6. The method of claim 5, X has a length of from about 15 to about 30 nucleotides.

7. The method of claim 1, wherein the single-stranded target sequence is a single-stranded ribonucleic acid sequence.

8. The method of claim 1, wherein the nuclease comprises an amino acid sequence having at least 80% sequence identity to any one of SEQ ID NOs:100, 101, and 110.

9. The method of claim 1, wherein:
   Y comprises a nucleic acid sequence having at least 80% sequence identity to any one of SEQ ID NOs:179-186, or a complement of any of these, or a fragment thereof;
   L is a bond or comprises a nucleic acid sequence having at least 80% sequence identity to any one of SEQ ID NOs:187-191, or a complement of any of these, or a fragment thereof; and
   Z comprises a nucleic acid sequence having at least 80% sequence identity to any one of SEQ ID NOs:192-212, or a complement of any of these, or a fragment thereof.

10. The method of claim 1, wherein W has a length of from 0 to about 20 nucleotides, X has a length of from about 10 to about 30 nucleotides, Y has a length of from about 10 to about 40 nucleotides, L has a length of from 0 to about 10 nucleotides, and Z has a length of from about 10 to about 90 nucleotides.

11. The method of claim 1, wherein the structure has a length of from about 100 to about 200 nucleotides.

12. The method of claim 1, further comprising detecting a label on the synthetic guiding component or a reporter on a nucleic acid substrate, wherein a detectable signal is provided upon recognition of the single-stranded target sequence by the synthetic guiding component.

13. The method of claim 12, wherein the nuclease comprises an amino acid sequence corresponding to SEQ ID NOs: 100 or 101.

14. The method of claim 13, wherein the nuclease comprises an amino acid sequence corresponding to SEQ ID NO: 101.

15. The method of claim 13, wherein the nuclease comprises an amino acid sequence corresponding to SEQ ID NO: 100.

16. The method of claim 1, wherein the single-stranded target sequence comprises an RNA sequence of a virus, the virus having a lifecycle consisting of solely RNA molecules.

17. A method of conducting a cleavage assay, the method comprising:
   incubating a synthetic guiding component with a nuclease and a single-stranded target sequence, the synthetic guiding component including a targeting portion configured to bind and/or cleave the single-stranded target sequence; and
   cleaving the single-stranded target sequence without a short DNA oligomer containing a proto-spacer adjacent motif (PAM) sequence (PAMmer);
   wherein the synthetic guiding component comprises a structure having the formula (I):

W—X—Y-L-Z or a salt thereof, wherein:
   W is an optional third portion comprising a nucleic acid sequence of from about 1 to 20 nucleic acids;
   X is the targeting portion comprising a nucleic acid sequence configured to bind to a target site of the single-stranded target sequence;
   Y comprises a nucleic acid sequence having at least 80% sequence identity to any one of SEQ ID NOs:150-155, or a complement of any of these;
   L is a bond or comprises a nucleic acid sequence having at least 80% sequence identity to any one of SEQ ID NOs:156-161, or a complement of any of these;
   Z comprises a nucleic acid sequence having at least 80% sequence identity to any one of SEQ ID NOs:162-178, or a complement of any of these; and
   the nuclease comprises an amino acid sequence having at least 80% sequence identity to any one of SEQ ID NOs:100, 101, and 110.

18. A method of conducting a cleavage assay, the method comprising:
   incubating a synthetic guiding component with a nuclease and a single-stranded target sequence, the synthetic guiding component including a targeting portion configured to bind and/or cleave the single-stranded target sequence; and
   cleaving the single-stranded target sequence without a short DNA oligomer containing a proto-spacer adjacent motif (PAM) sequence (PAMmer);

wherein the synthetic guiding component comprises a structure having the formula (I):

W—X—Y-L-Z or a salt thereof, wherein:

W is an optional third portion comprising a nucleic acid sequence of from about 1 to 20 nucleic acids;

X is the targeting portion comprising a nucleic acid sequence configured to bind to a target site of the single-stranded target sequence;

Y is a first portion comprising a nucleic acid sequence configured to interact with a nuclease configured to cleave the single-stranded target sequence;

L is a linker; and

Z is a second portion comprising a nucleic acid sequence configured to interact with the nuclease and the first portion;

wherein the nuclease is a SauCas9 or CjeCas9 protein and the single-stranded target sequence is a single-stranded ribonucleic acid sequence.

19. The method of claim 18, wherein the nuclease is a CjeCas9 protein.

20. The method of claim 18, wherein the nuclease is a SauCas9 protein.

21. The method of claim 18, wherein:

Y comprises a nucleic acid sequence having at least 80% sequence identity to any one of SEQ ID NOs:150-155, 179-186, or a complement of any of these; and Z comprises a nucleic acid sequence having at least 80% sequence identity to any one of SEQ ID NOs:162-178, 192-212 or a complement of any of these.

22. The method of claim 18, wherein:

L comprises a bond or a nucleic acid sequence having at least 80% sequence identity to any one of SEQ ID NOs:156-161, 187-191, 226-231, and 265-269, or a complement of any of these.

23. The method of claim 18, wherein W and/or Y comprises one or more modified nucleic acids or bulges.

24. The method of claim 18, wherein the single stranded target sequence recited for X is a single-stranded human mRNA target sequence or a single-stranded pathogen target sequence.

25. The method of claim 18, X has a length of from about 15 to about 30 nucleotides.

26. The method of claim 18 wherein the nuclease comprises an amino acid sequence having at least 80% sequence identity to any one of SEQ ID NOs:100, 101, 104, 110, and 111.

27. The method of claim 26, wherein the nuclease comprises an amino acid sequence having at least 80% sequence identity to any one of SEQ ID NOs: 104, and 111.

28. The method of claim 18, wherein W has a length of from 0 to about 20 nucleotides, X has a length of from about 10 to about 30 nucleotides, Y has a length of from about 10 to about 40 nucleotides, L has a length of from 0 to about 10 nucleotides, and Z has a length of from about 10 to about 90 nucleotides.

29. The method of claim 18, wherein the synthetic guiding component has a length of from about 100 to about 200 nucleotides.

30. The method of claim 18, further comprising detecting a label on the synthetic guiding component or a reporter on a nucleic acid substrate, wherein a detectable signal is provided upon recognition of the single-stranded target sequence by the synthetic guiding component.

31. The method of claim 18, wherein the single-stranded ribonucleic acid sequence is the RNA sequence of a virus, the virus having a lifecycle consisting of solely RNA molecules.

32. The method of claim 18, wherein the nuclease comprises an amino acid sequence having at least 98% sequence identity to any one of SEQ ID NOs: 100, 101, 104, 110, and 111.

33. The method of claim 18, wherein Y comprises a nucleic acid sequence having at least 90% sequence identity to any one of SEQ ID NOs:150-155, 179-186, or a complement of any of these; and Z comprises a nucleic acid sequence having at least 90% sequence identity to any one of SEQ ID NOs:162-178, 192-212 or a complement of any of these.

* * * * *